United States Patent 11,098,302 (IDENTIFICATION OF POLYNUCLEOTIDES ASSOCIATED WITH A SAMPLE) - sequence listing, part 76

SEQ ID NO: 261654 - DNA, 730 bp, Homo sapiens
  misc_feature: GYAE6OF01BY3S4.9.1.A01.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagtgatacgtctcacgaccggtgctcgatttagacgtctcatcaagggaaggaagggggggggtctcaggaggcgagcgctctcggggacgtctccaccatggcctgggctctgctattcctcaccctcctcactcagggcacagggtcttgggcccagtctcgccctgactcagcctgcctcgtgtctgggtctccgtggacagtcggtagccatctctgcactggaactacagtgacggttggngacttataattatgtctcctgtatcaacaacaccagacaacgcccccaanctattnttctgatcgtacaacacgtccggaccccgtagggtactttctagtactccgtacttacgtcgtcggtccttaccgtaacgtcgtacggaccaaccggacccggtaccctcccgtacgaccctacgtccgtcggtaccgggtccgttaccggggtcgtacgggtaacgggacggtacggtaccttacgtaaccttacgttaaccgtcggtaccgtacggtaccttacgtaataaccgtaacccgaaccgtacggacccgtaaccgtaccttacgttcggtttcgggtaccgggacgggtaacggtaccgttaaccggtaaccgtaccgggttaacccgttacccggttaaccgggtcccgtaacccggacccccggtaacggtccccgttaccccggtcccccggttaccgggtcccgttaccccgg

SEQ ID NO: 261655 - DNA, 680 bp, Homo sapiens
  misc_feature: GYAE6OF01DNUP1.9.1.A01.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
tcagtgatacgtctcacgaccggtgctcgatttagacgtctcatcaaggaagggaaggggggggtctcaggaggcagcgctcgtcgggacgtctccaccatggcctgggctctgctattcctcaccctcctcactcagggcacgagggtcttgggcccagtctgccctgactcagcctgcctcgtgtctgggtctcctggacagtcggtagccatctcctgcactggaactacngtgacgttggncttatattntgtctctggtatcaacaacaccaggacaaacgccccccaactctatttattctgatgtacaacactccggaccccagggtattctgtactcgcttctctggtctaccgaagtctcggactaaccgaccggccttcccgtacgaccctagttccgtccgtcgggtccgtaccggggtcttacgggacgggtacggaacggtccttaccgtaacgttagtttaccgtggtcctaacggtccttaaccgtattaaccgttaaaccgaacccgtaacggaacccgtactaacccgttcgttacgggtttccggttacgggccgggtaagggtaccgttacggaaccgtcggtaccccggttacggttacgggtaccaacggaccccgtaacggtcccgtaccggtacccccccggtggtccttaccccgg

SEQ ID NO: 261656 - DNA, 576 bp, Homo sapiens
  misc_feature: GYAE6OF01CZ1QD.9.1.A01.1.454.CMB.1.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagtgatacgtctcacgaccggtgctcgatttagacgtctcatcaaggaagggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaaccagcagttgggtagttttaacctgtctccgtggtaccaacaccacccagacaaagcccccanactcttaattangagtcactaagccggcctcgaggggtttctggtcgtcttctctcgcctccaagttctggacaacgacggtccctccctagacaagtctcgtgggcctcagtctgacgacgngctagattattacngcctgtctnacgttntgctaggtttcgtttcctntttaacaagtagttacgttcgggcggtacgggaccctggacgtcgaccgtctggacgtccgacgcccgtaggccgtccgccccctcggtcacccttctcccgtccccctacccg

SEQ ID NO: 261657 - DNA, 766 bp, Homo sapiens
  misc_feature: GYAE6OF01C08JY.9.1.A01.1.454.CMB.1.raw
  modified_base (501)..(501): a, c, t, g, unknown or other
  misc_feature (501)..(501): n is a, c, g, or t
  modified_base (723)..(723): a, c, t, g, unknown or other
  misc_feature (723)..(723): n is a, c, g, or t
tcagtgatacgtctcacgaccggtgctcgatttagacgtctcatcaagggaagggaaggggggggtctcagggaggcagcgctctcgggacgtctccaccatggcctgggctctgctattcctcaccctcctcactcgagggcacgagggtcttggcccagtctcgccctgactcacgcctgcctcgtgtctgggtctcgtggactaggtcggtagccatccgtcctgacctacgtacggaaacttaacgaggttacggtacggtttggttactactttaaagtttaattgttcgtccttccgttaggtaactaccgaaacaaccgaaccgacggaacctaaacccgacccccctaaatacttaacttttacttcgttatacggttctaaccaaacgtaacccgtcccgggaccccgtagggttactttcgacgtacgtcgttcttcttcggtacgtacaccgtactcgtacgacaaccgtccgcccttcgtacgtacctntcctacgtcgttactcgtaccgtcgacggtacggtaacggtagggtactaacgtttctacgtacgtacgtacttacgacgttacttaacgtaaccgtaacccgttttcccggttacgggtttcggggttacggtaccggggtaccgggtacggaccgttacgtcggtacccgttcggtacccggtttcgaacggtccgtacccgaaccggacccgggtaccnccccgttacccggtccctccggtacccgttccgttacccccgg

SEQ ID NO: 261658 - DNA, 774 bp, Homo sapiens
  misc_feature: GYAE6OF01EROGC.9.1.A01.1.454.CMB.1.raw
  modified_base (220)..(220): a, c, t, g, unknown or other
  misc_feature (220)..(220): n is a, c, g, or t
tcagtgatacgtctcacgaccggtgctcgatttagacgtctcatcaaagggaagggaagggggggggtctcagggaggcgagcgctcgtcgggacgtctccgaccatggcctgggctctgctattcctcaccctcctcactcagggcacagggtcttgggcccagtctcgccctgactcagcctgcctccgtgtcgtggtctccgtaggacagtcggtancctatctctgctacgtggaactacagtcgtacggttggtgtacttaagtaattagtgttccttcgttaggttaattaccaaaccgtaaaccgaacccgaaggaaccaaaaccgtaccccccctaaacttcctaattttaccgtttcgtaggtacgttacgtaaccaaacgtaacgtcccggacccccgtaagggttactttcgagtactcgtacctttacgtcgtacggtaccttaccgtaacgtcgtacggaacctaaccggtacccggtaccctacccgtacggtaaccctacgttaccgttccggtaccgggtcccgtacggggtacttacggggacgggtaacggacgtacctaaccgtaactttaccgtacgtcggactacggtctaactataaccgtaaccgaacgacggaccgtaacgtacgttcggtcgttacggttcggacgggtaacgtccacggtaacgtccggtaacccgttacggtaccggacctaccggtaacccggaacggttcccgtacccgggtacccccgttggacccgttacccg

SEQ ID NO: 261659 - DNA, 719 bp, Homo sapiens
  misc_feature: GYAE6OF01EK4CP.9.1.A01.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
tcagtgatacgtctcacgaccggtgctcgatttagacgtctcatcaaggaagggaaggggggggtctcaggaggcagcgctctcgggacgtctccaccatggcctgggctctgctattcctcaccctcctcactcagggcacgagggtcttgggcccagtctgccctgactcagcctgcctccgtgtctgggtctccgtggacaggtcggtagccatctcctgcactggaactangtgacgttggtntctttaataattntgtctcctggtatcaacaacaccaggacaaaccgcccccaactctaatttactttctgtatgtacaaactaacgtcccggacccccgtagggtcttttcgtagacttccggctttccgtcgtcggtccttaccgaacgttcgtacggacctaaaccgcccggtccctaccccgtcgaaccctacgttccgtccggttcggggtcccgtccggggtccgttacgggacgggaaccggtacgggtccttaaccgtaaccttaacgtttacccgtggtacctacggtccttaccgtaattaaccgtaaccgaaacccgacgtaccgaacctaccgttcgttacgggttaccggttcgggacgggtacggtacgtacggtaacgtccgggtacccgtaccggtcgggtacctaccggacccggtaacgggtccctacccggccccccgttggtccctaccccg

SEQ ID NO: 261660 - DNA, 625 bp, Homo sapiens
  misc_feature: GYAE6OF01EBNSC.9.1.A01.1.454.CMB.1.raw
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagtgatacgtctcacgaccggtgctcgatttagacgtctcatcaagggtaagggggaaggggggggtctcgagggaggcagcgctcgtcgggacgtttccaccatggcctgggctctgctacttcctcacctcctcactcagggcacagggtcttgggcccaggtcttgccctgactcagcctgcctccgtgtctgggtctccgtggacagtcgtagccatcncctgcactggaactacagtcgacgttggtgacttattaacttagtgtctctgtatcaacacnccagacaacgcccccgaatactacttattctgtatgcaacatccggacccgaaggtactttcagcgtctcgttctcgcgtctacgtacgtgtacgaccacgcgtccctccgtacgacctctcgtacggcggtccgtcggcgtcggacggacggagactacgtaacgttnttacgngtacagttcttacagttaacnccgtaacgcgtactaaccgtcgttaccgttgttaccggtcggggtagggacggttaacgtacgggtacgtacccgggtcggaccgttcggacggaccgtacccggacgtccgacccgtcccgtcggtacccgtcgttcccgg

SEQ ID NO: 261661 - DNA, 803 bp, Homo sapiens
  misc_feature: GYAE6OF01COZTC.9.1.A01.1.454.CMB.1.raw
  modified_base (221)..(221): a, c, t, g, unknown or other
  misc_feature (221)..(221): n is a, c, g, or t
tcagtgatacgtctcacgaccggtgctcgatttagacgtctcatcaagggaaggaaggggggggtctcaggaggcagcgctctcgggacgtctccaccatggcctgggctctgcctcctcctcaccctcctcactcagggcacgaggtcctgggcccagtctgccctgactcagcctccctccgcgtccgggtctccgtggacagtcagtcacatctcgtncgctggcaccacaatgtacgttttggttaggttttaattctgtctccgtacgtaacaaaaaccaccaacgacaaaccgtaccccaaactcccttactatttactacctagtaacctaacgtacggccgggttaccctcggtaccgggtcccttcgggtccgttcttctcggtgtcctacttacgtctacgaacgtaccgacccggtcccttacccgtcggtacccgttcgtccggttacgggtcccgtaccgtacgggcgttacggaacggtcggtacggacggttcgttagttaacttttactaccgtacggtcccttaacctcgttaaactcggtaggaccgtacgggtaaccgttacggtaaccgttgtaccgtaacggtttacggttacggttaacgtttcggggttaacccggggacgggtaaaccgggggtaacccgttacggaaccggtttaccggtaaaccccggtttaacgttaaccggttaccccggacggaaaccccggggtaccgaccccgggttaccggtaccccccggtttacggtaacccccgttcctaaccccgggtttacccccg

SEQ ID NO: 261662 - DNA, 750 bp, Homo sapiens
  misc_feature: GYAE6OF01AZ7RM.9.1.A01.1.454.CMB.1.raw
  modified_base (206)..(206): a, c, t, g, unknown or other
  misc_feature (206)..(206): n is a, c, g, or t
  modified_base (401)..(401): a, c, t, g, unknown or other
  misc_feature (401)..(401): n is a, c, g, or t
  modified_base (528)..(528): a, c, t, g, unknown or other
  misc_feature (528)..(528): n is a, c, g, or t
  modified_base (597)..(597): a, c, t, g, unknown or other
  misc_feature (597)..(597): n is a, c, g, or t
tcagtgatacgtctcacgaccggtgctcgatttagacgtctcatcaaggaagggaagggggggggtctcaggaggcagcgctctcgggacgtctccaccatggcctgggctctgctattcctcaccctcctcactcgagggcacgagggtcttcgggcccagttctcgccctgactcacgcctgcctcgtgtcgtgggtccttcgnggactacggtcggtagcctatcctccgtgaccacgtacggtaaactaacgacggtcggtacggtttggtctaactttaagttaaacttgtcgttcttccgtaggttaacactaaaccaacctaccgaacggaaccaaacccgtaccccctaacgtacttactttaactttcgtaggtacttacgtaaccctaaanacccggtcccggaccccggtaaggtttacgtttccgacgtacgtccgttccttacgtcgtccggtaccttaccgtaacgttcgacggtaacctacccgtacccggtccgttacccctacgtaacccncttaccgttccggtacgggccggtaccggtcgtagggacgtacggcgtacgttacctacgttacttacncgactacgtcctaacgaacgttaacaccgtaaacgtcggaaccttacgtacgttcggttacgtaccgggtagggaaccgggtagacgtacgtaaccggcgttaccggtacgtacgacgtacgaccgtacgcctacccgccgtcgtctacccgg

SEQ ID NO: 261663 - DNA, 294 bp, Homo sapiens
  misc_feature: GYAE6OF02H6KG4.9.1.A01.1.454.CMB.1.raw
  modified_base (209)..(209): a, c, t, g, unknown or other
  misc_feature (209)..(209): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (292)..(294): a, c, t, g, unknown or other
  misc_feature (292)..(294): n is a, c, g, or t
tcagtgatacgtctcacgaccggtgctcgatttagacgtctcatcagggaatccaacaggccactggcatcccagacaggttcagtggcagtgggtctgggacagacttcactctcaccatcagcagactggagcctgaggattttgcagtgtattactgtcagcagtatcataggtcaaacaccttcggccaagggacacgactgganattaaaaggactgtaggctgcaccatctgtcttcatcttccgcatctgaancgtatcactgancggntggcaaggcncatagnnn

SEQ ID NO: 261664 - DNA, 303 bp, Homo sapiens
  misc_feature: GYAE6OF02FW4ZU.9.1.A01.1.454.CMB.1.raw
  modified_base (291)..(291): a, c, t, g, unknown or other
  misc_feature (291)..(291): n is a, c, g, or t
  modified_base (297)..(303): a, c, t, g, unknown or other
  misc_feature (297)..(303): n is a, c, g, or t
tcagtgatacgtctcacgaccggtgctcgatttagacgtctcatcaggggaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaactgtggctgcaccatctgtcttcatcttcccgcatctgaagacgtatcactgagcgggctggcaaggcncatagnnnnnnn

SEQ ID NO: 261665 - DNA, 505 bp, Homo sapiens
  misc_feature: GYAE6OF02J1ZLZ.9.1.A01.1.454.CMB.1.raw
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(436): a, c, t, g, unknown or other
  misc_feature (432)..(436): n is a, c, g, or t
  modified_base (438)..(439): a, c, t, g, unknown or other
  misc_feature (438)..(439): n is a, c, g, or t
  modified_base (443)..(443): a, c, t, g, unknown or other
  misc_feature (443)..(443): n is a, c, g, or t
  modified_base (445)..(449): a, c, t, g, unknown or other
  misc_feature (445)..(449): n is a, c, g, or t
  modified_base (451)..(452): a, c, t, g, unknown or other
  misc_feature (451)..(452): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (460)..(461): a, c, t, g, unknown or other
  misc_feature (460)..(461): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (495)..(497): a, c, t, g, unknown or other
  misc_feature (495)..(497): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
tcagtgatacgtctcacgaccggtgctcgattttagacgtctcatcaggggtaagtccaacagggaccactggcatcccagaacaggttccaggtggcagtgggtctgggacagacttcactctcaccatcagctagactggagcctgaggattttgcagtgtattacctgtcagtcagtatcatagggtcaaacacgttcggaccaaggggaccacggactgggagagttaaacggaactggtaggcgtgtccaccgagtcttacgttccttcgaacttccttacccggcctaattccttgggaaagaccggtactccacgttaggaacggtcggggccttgggacgtaacgggcggaccggaagttaggctccntcnacacgactacncncncaganacgagananacacncagacananananananannnnnannagancnnnnngnnagntcntnngagnanatanananantctctactctctcnctcnnnctacncnc

SEQ ID NO: 261666 - DNA, 405 bp, Homo sapiens
  misc_feature: GYAE6OF02JCECF.9.1.A01.1.454.CMB.1.raw
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (331)..(333): a, c, t, g, unknown or other
  misc_feature (331)..(333): n is a, c, g, or t
  modified_base (335)..(335): a, c, t, g, unknown or other
  misc_feature (335)..(335): n is a, c, g, or t
  modified_base (337)..(338): a, c, t, g, unknown or other
  misc_feature (337)..(338): n is a, c, g, or t
  modified_base (340)..(341): a, c, t, g, unknown or other
  misc_feature (340)..(341): n is a, c, g, or t
  modified_base (343)..(343): a, c, t, g, unknown or other
  misc_feature (343)..(343): n is a, c, g, or t
  modified_base (346)..(355): a, c, t, g, unknown or other
  misc_feature (346)..(355): n is a, c, g, or t
  modified_base (357)..(404): a, c, t, g, unknown or other
  misc_feature (357)..(404): n is a, c, g, or t
tcagtgatacgtctcacgaccggtgctcgattttagacgtctcatcagggggtaagtccaacagggaccactggcatcccagaacaggttccaggtggcagtgggtctgggacagacttcacgtctcaccatcagcagactggagcctgaggattttgcagtcgtattacctgtccagtcagtatcatagggtcaaacaccgttcggaccaagggacacggacctgggagagttaaaggaactgtggactgccacgagtctgtcttcattcttccgctatctgagacgtagtcactgacgacggggcctggcaaggcgcgagtagncntgnnnananncnnancgnnnnnnnnnnannnnnnnnnnnnnnnnnnnnnnnnnnnnnnnnnnnnnnnnnnnnnnnnc

SEQ ID NO: 261667 - DNA, 666 bp, Homo sapiens
  misc_feature: GYAE6OF02H56Q8.9.1.A01.1.454.CMB.1.raw
  modified_base (341)..(341): a, c, t, g, unknown or other
  misc_feature (341)..(341): n is a, c, g, or t
tcagtgatacgtctcacgaccggtgctcgatttagacgtctcatcaaggaagggaaggggggggtctcaggaggcagcgctctcgggacgtctccaccatggcctgggctctgctattcctcaccctcctcactcagtgtacagggtcctgggcccagtccgccctgactcagccctaccgccgtgtccgggtctccgtggacagtcgatcaccatctcgtgcactgggaacgaatagcgaactagtttgggtaggcctactaaatcaatgtctcctggtaactaataacagtaccaggacaaacgacccccaaaatcaacttaaatttactagtatcgtntttaacgaccggccctacgtagggtactttcgttctcggttacgtctggcctacaagtcgtacgggaacaccggcctacccgtgacctatcctcgtacggtacttcgacgtcctaggaggaacggtagggttagtaactttactcgtgactagttacagttacttacgaacgtaaacccttcccgttaggtttcggggttcgttcgggtacgggtacggaccgtatcggtacgtaccgtaccgttcgagtacgctaaccggaccgaaggtcctacggtcccccgtacggtacctacccgttcgttacccggttccccgtaccccg

SEQ ID NO: 261668 - DNA, 779 bp, Homo sapiens
  misc_feature: GYAE6OF02HDE9H.9.1.A01.1.454.CMB.1.raw
  modified_base (240)..(240): a, c, t, g, unknown or other
  misc_feature (240)..(240): n is a, c, g, or t
tcagtgatacgtctcacgaccggtgctcgatttagacgtctcatcaaggaagggaaggggggggtctcaggaggcagcgctctcgggacgtctccaccatggcctgggctctgctattcctcaccctcctcactcgagggcacgagggtcttgggcccagtctgccctgactcagcctgcctcgtgtctgggtctccgtggacaggtcggtagccatcctcctgcacgtggaaactaacngtgacgttggtgtacttaataattatgttctcctggtactcaaacaaccaccaggaccaaaccgccccccaatctaatttattctagtatcgtaccaactaacgtcccggacccccgtagggttactttcgtgtacttccgtacttcgtcgtcggtcctaccgtaagttccgtacggacctaaccggacccgtccccttacccgtacgaccctacgttccgtcggtccgggtacccgttccgggtacgtacggaacgggtaccggtacgggtcctaaccgtaccgttaacgttaccgtcgaccgtaacgtcccttaacgtaaccttaaaccgtaacccgaaaacccggtaccgtaaacccgtaacccttaccgtttaccgtttacggggttttaccggttacccgggggaccggggtaaccgggtaccgttaacgggtaaccgtacccggttaccccggttacggttaaccgggtacccgaaccggtaacccggacggttcccgtaccccggtaccccgttccggtacccttaccccgg

SEQ ID NO: 261669 - DNA, 760 bp, Homo sapiens
  misc_feature: GYAE6OF01DJSZ8.24.19.B08.1.454.CMB.1.raw
  modified_base (603)..(603): a, c, t, g, unknown or other
  misc_feature (603)..(603): n is a, c, g, or t
  modified_base (740)..(740): a, c, t, g, unknown or other
  misc_feature (740)..(740): n is a, c, g, or t
tcagactactatgtcacgaccggtgctcgatttagtgagtcagtacggtacagtcaggactacagcatggacatgagggtaccccgctcgagcgtcctaggggctcctgctactctcggctccgacggtgccacgatcgtgacattccagatgacccaggtcctccgactcctccctgttctgcatcctcgtaggagacagagtccacccgatcacttggttgggccaagttgacgaccattacgcgaagccttacgtttcgaggttcggactagtacaaatttcaaaaccgtagggaaaccgtcccccgttaaacctccgtgaatccttacaacgtacgacccgtaaccaactttaccactacggttacgggttacccaattcccagggttacaaggtcggacctaaagtcgggaattccgttggggaacctagtacgtttcgaccttactacgtaacctagttccaagggtcctaacggtcccgttacggaccgtaaaccccttgtaaaccggttaacccttttaggacccttaaacgtttacttacgttacgtaccgaaacgtacgtaacgttttaaccgtacggttttacccccgggtntaaccccgtttcggggaccggggtaaggggtacccgaaagggttccgggaagaaccgttaccgaaaccgtacggtaaacgttcgggtaggtacccgtgggaccctaacgaacgtttcgttacggttaccctttaacncggttttcccgttacccccg

SEQ ID NO: 261670 - DNA, 763 bp, Homo sapiens
  misc_feature: GYAE6OF01DAF3M.24.19.B08.1.454.CMB.1.raw
  modified_base (740)..(740): a, c, t, g, unknown or other
  misc_feature (740)..(740): n is a, c, g, or t
tcagactactatgtcacgaccggtgctcgatttagtgagtcagtaaaggaaagggcacagcatggacatgacgggtcccgctcagctcctggggctcctgctactctggctcgaggtgccagatgtgacatccagactcgaccagtctccactcctcctgtctgctagtcgtaggtaggacgacgaggactccaactatcgtacttgggtcgggactaaggtgaacgtaacctagttacgcgtacgttctttacgtttaggacggtttacggactacgttaacgtaaacgttaaccgaaaaacccggtaacgggtaaaccctaccccgttaaaccttccgtaagtacctactaacgttaccgtagtaccgtaccttaaacgttacgacgttacggtccggtacctactccgtacggtcgacggttgacgtaagtacggtactaggtacggtaactaggtcctaccgtactacgtaccaacgtcgtacgacgtcgtacgtcgtacaacgtaactaggtacttacgttacgaaactttaaccgttatagttaaccggaacttaaacgtcggttaaccgttccggtaccggtttaccccgaccgttaccggggttccggggaaccggtaacggggaaccttaagggtacggaactaccgtactaaccggaacgtcggttgaacggtcctccgaacttaccgtcgtttaccggtcctttaacccgttcctaccccggttacccncccgtaacgtaccgttaaaccgg

SEQ ID NO: 261671 - DNA, 692 bp, Homo sapiens
  misc_feature: GYAE6OF01BM1WX.24.19.B08.1.454.CMB.1.raw
  modified_base (684)..(684): a, c, t, g, unknown or other
  misc_feature (684)..(684): n is a, c, g, or t
tcagactactatgtcacgaccggtgctcgatttagtgagtcagtaaagggaaagggcacagcatggacatggacgggtccccgctcagctccgtggggctcctgctactctggctccggaggtgccagatgtgacatccagatcgaccagtctccatcctcctgtctgcattcgtaggaggagacagtagtccactatacgtacttgggtggactaaaggtcgaacgtacctaagttacgctagtctttacgtttgaggttggacctaagtaccaagttaaccaaaccggaacggtaaacctcccctaacgtctagacttctaacgttcgtcgtaccgttactaacgttaccgtaagtacgggttaccggtacctagtccgttaaggttcctaggtacggtactaaggttcggtaacgtcggtaacgggatacgtacgttccgaacttcgacacgtctacgtagctagtacgttcgaactaacgtagtaacgttcttaaccaagttaaccttaattacgtacgtacctaaagaccggttataacccgggttacttccccggtaagtccggttacgggaacgggtaccgaacgggtagtcgacgtactaccgacgtacggttaacgtgggtaccgacgtcgtaccaacttcgtcgttaccgtacttcctacgtccctaccgttanctaccggg

SEQ ID NO: 261672 - DNA, 782 bp, Homo sapiens
  misc_feature: GYAE6OF02HIFYM.24.19.B08.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (443)..(443): a, c, t, g, unknown or other
  misc_feature (443)..(443): n is a, c, g, or t
tcagactactatgtcacgaccggtgctcgatttagtgagtcagtaaagggaaaggggacccaaaaaccacacccctccttagggagaatcccctagatcacagctcctcaccatggactggacctggagctattccttttcttggtggcaggcagcaaccggtgccctctcccgaggttcagctggagcagtctggagctgagtgaagacgcgtgggcctnagtggaaggtcctcgnggcaaggtccttgttggttaacttacttttaacacgtagtgtatccacgtggtcgacgacgtacggcccgtgggacaaggtcgttaggagtaggtaggtgggagtggactggagtgtagttaaggtagtaaggtaaaacctacgtaaaactagttcgaacgaaacgtaaggttaaacggtttcggggaacgtaagtaaccggttanaaacccggtattaaccgaacctaacggaacgtaacccgactacgtaccccgaaccgtcccgaaccggtaacttacccgaacgttacggagggaccggacgggtacggggtaccacgggtaccgtaaccgacccgaaccgggtacggacccggtacggtccgtttaacggtcttaccggtagtaccgggtagaacgtaagttaaccgtaccgttaccgggcgttttaacggtacggggttaaacgggtcccttagggtaaccccgtttacggggtacccgggtaccggtaaaccggggttacccgttaccggggttcccgttccggtacccgtttccggg

SEQ ID NO: 261673 - DNA, 156 bp, Homo sapiens
  misc_feature: GYAE6OF01BI90P.25.59.F04.1.454.CMB.1.raw
  modified_base (155)..(156): a, c, t, g, unknown or other
  misc_feature (155)..(156): n is a, c, g, or t
tcagactgtacagtcacgaccggtgctcgatttagtacacacacttagggattgggaccaaggtcaccgtcctaggtcagcccaaggccaacccactgtcactctgttcccgccctcctcactgtacagtctgagcggctggcaaggcgcatagnn

SEQ ID NO: 261674 - DNA, 156 bp, Homo sapiens
  misc_feature: GYAE6OF01EYGXS.25.59.F04.1.454.CMB.1.raw
  modified_base (156)..(156): a, c, t, g, unknown or other
  misc_feature (156)..(156): n is a, c, g, or t
tcagactgtacagtcacgaccggtgctcgatttagtacacacacttagggattgggaccaaggtcaccgtcctaggtcagcccaaggccaacccactgtcactctgttcccgccctcctcactgtacagtctgagcgggctggcaaggcgcatagn

SEQ ID NO: 261675 - DNA, 158 bp, Homo sapiens
  misc_feature: GYAE6OF01EQZ0D.25.59.F04.1.454.CMB.1.raw
  modified_base (157)..(158): a, c, t, g, unknown or other
  misc_feature (157)..(158): n is a, c, g, or t
tcagactgtacagtcacgaccggtgctcgatttagtacacacacttagggattgggaccaaggtcaccgtcctaggtcagcccaaggccaaccccgctgtcactctgttcccaccctcctcactgtacagtctgagcgggctggcaaggcgcatagnn

SEQ ID NO: 261676 - DNA, 164 bp, Homo sapiens
  misc_feature: GYAE6OF01A9FKH.25.59.F04.1.454.CMB.1.raw
  modified_base (157)..(164): a, c, t, g, unknown or other
  misc_feature (157)..(164): n is a, c, g, or t
tcagactgtacagtcacgaccggtgctcgatttagtacacacacttagggattgggaccaaggtcaccgtcctaggtcagcccaaggccaaccccactgtcactctgttcccgccctcctcactgtacagtctgagcgggctggcaaggcgcatagnnnnnnnn

SEQ ID NO: 261677 - DNA, 549 bp, Homo sapiens
  misc_feature: GYAE6OF01B566J.25.59.F04.1.454.CMB.1.raw
  modified_base (280)..(280): a, c, t, g, unknown or other
  misc_feature (280)..(280): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccattagtggtcttaagcgtgacaaattttngcagactcggtgaacggccgttcaccatctccagagacaacgccgacgactttctctttcngcaaatgaacngcctcagacgccgaggacacggctgtttattcngtgcgagaggagtgggacgaaacgtggctcgtacggaggtgatgtcttttgatttcgtgggccaagggactagtggtcaccgtctcttcacgcctccaccgacggcccagtccgtccttccccgtggcccgccctcgcctccgagacgccacccgtccgagacg

SEQ ID NO: 261678 - DNA, 533 bp, Homo sapiens
  misc_feature: GYAE6OF01DKURA.25.59.F04.1.454.CMB.1.raw
  modified_base (473)..(473): a, c, t, g, unknown or other
  misc_feature (473)..(473): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacggccggttcaccatctccagagacaacgccgacgactttctctttctgcaaatgaacagcctcagagccgaggacacggctgtttatttctgtgcgagaggagtgggcgaaaactggctctacggaggtgatgcttttgatttctggggccaagggactagtggtcaccgttctcttcagcctccaccaagggccatcggtcttccccctggccgccctgcctccaggcgcacctccgagacgcacgngccggccctgggctgccctggtcaaggctacttccactgtacngtctgacgcgggntcgg

SEQ ID NO: 261679 - DNA, 574 bp, Homo sapiens
  misc_feature: GYAE6OF01B7XZU.25.59.F04.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (459)..(459): a, c, t, g, unknown or other
  misc_feature (459)..(459): n is a, c, g, or t
tcagactgtacagtcacgaccggtgctcgatttagtacacacacttaggattgggagggcctggtcaagcctgggggtcccgaagactctcttgtgcagtcctctggattcaacttcgaaagctacagcatggaactggatccgcaggcctccgggaaggtctgcagtggatttcatccattaggtggtcttaaggcgtgacaaattttangcagactggtnaacggccgttnaccatcgtccaagagacaacgccgacgacttttctactttctgcaaaatgaacagcctcagtagccgaggactaacggcgtgtttaatttctcgtgtccggtagaggacgtgggcgaaaaacgtggactcgtaccggtaggtgaagtgtcttttgatttcgtgggtccaagggactagtggtcacgtctcttcacgcctcacaaggccagtcgtcttcccctgccncctgctcagagcaccgtccgacgacgtcctacgacggcggaccgtggcgtgcctaggtaccgaaaggacgttaccgttccacgtcgtacgtacgtctagacgtcgggctaccggg

SEQ ID NO: 261680 - DNA, 557 bp, Homo sapiens
  misc_feature: GYAE6OF01C29B7.25.59.F04.1.454.CMB.1.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
  modified_base (446)..(446): a, c, t, g, unknown or other
  misc_feature (446)..(446): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccattagtggtcttaagcgtgacaaattttangcagactcggtgaacggccggttnaccatctccagagacaacgccgagtactttctctttcngacaaatgaacngcctcagagccgagacacggctgtttattctgtgcgagaggagtgggacgaaactggctacgtacggaggtgatgtcgttttgagtttcgngggtctaagggctagtgtcacgtctcttcacgtcctccaccgaggcccacgtccggtcccttccccgtggcccgccctcgcctaccgacggacaccgacctccggagaccg

SEQ ID NO: 261681 - DNA, 191 bp, Homo sapiens
  misc_feature: GYAE6OF01EMA7W.25.59.F04.1.454.CMB.1.raw
  modified_base (155)..(191): a, c, t, g, unknown or other
  misc_feature (155)..(191): n is a, c, g, or t
tcagactgtacagtcacgaccggtgctcgatttagtacacacacttagggattgggaccaaggtcaccgtcctaggtcagcccaaggccaacccactgtcactctgttcccgccctcctcactgtacagtctgagcggctggcaaggcgcatagnnnnnnnnnnnnnnnnnnnnnnnnnnnnnnnnnnnnn

SEQ ID NO: 261682 - DNA, 690 bp, Homo sapiens
  misc_feature: GYAE6OF01C9O71.25.59.F04.1.454.CMB.1.raw
  modified_base (212)..(212): a, c, t, g, unknown or other
  misc_feature (212)..(212): n is a, c, g, or t
  modified_base (358)..(358): a, c, t, g, unknown or other
  misc_feature (358)..(358): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaaagcgtgacaaatttttangcagactcggtgaacggccggttcaccatctaccagagacaacgccgacgtactttctctttctgcaaaatgaacagcctcagagccgaggacacggcttgtttattcgtgtgcgagaggagtgggacgaaaactggctcgtaggnggtgatgtcttttgatttcgtgggacctaagggtactagtcggtcaccgtctcttcacgtcctaccgaaccgaacgggccctagttccgggttccctttcccccgtgggtcccgtcccccgtgcccgttacccgagggaccgtcctaaccccgtccggaacggacgcccgaaccgaccgggcccgggtccccgttcggggcccttccgggacccgttaggggtacccgtaaaaccggggacccttttaacccgtttaccccgaaaccggtttcggtaaacccgtacgttacccggttaagggaaccggggtcccggggtacccgtaacgggg

SEQ ID NO: 261683 - DNA, 539 bp, Homo sapiens
  misc_feature: GYAE6OF01A5FN9.25.59.F04.1.454.CMB.1.raw
  modified_base (208)..(208): a, c, t, g, unknown or other
  misc_feature (208)..(208): n is a, c, g, or t
  modified_base (367)..(367): a, c, t, g, unknown or other
  misc_feature (367)..(367): n is a, c, g, or t
  modified_base (527)..(527): a, c, t, g, unknown or other
  misc_feature (527)..(527): n is a, c, g, or t
tcagactgtacagtcacgaccggtgctcgatttagtacacacacttagggattgggaggcctggtcaagcctgggggtcccgaagactctcttgtgcagcctctggattcaacttcaaaggctacagcatgaactggatccgccaggctccggggaaggtctgcagtggatttcatccattagtggtcttaagcgtgacaaattttangcagactcggtgaacggccggttcaccatctccagagacaacgccgacgactttctctttctgcaaatgaacagcctcagagccgaggcacggctgtttattctgtgcgagaggagtgggcaaaacgtggctcgtacggagtgatgcttttgatttcgnggggccaagggactagtggtcaccgttctcttcagcctccaccaacgggcccagtccggtccttacccccgtggtccgccctgcctccgaggcgcgacctccgagacgcacgacgcgcccgtggctgccgtggtccaggctacgtccactgtactagtcngacgcggctcgg

SEQ ID NO: 261684 - DNA, 182 bp, Homo sapiens
  misc_feature: GYAE6OF01DXAAZ.25.59.F04.1.454.CMB.1.raw
  modified_base (144)..(144): a, c, t, g, unknown or other
  misc_feature (144)..(144): n is a, c, g, or t
  modified_base (160)..(182): a, c, t, g, unknown or other
  misc_feature (160)..(182): n is a, c, g, or t
tcagactgtacagtcacgaccggtgctcgatttagtacacacacttagggagttgggaccaaggtcaccgtcctaggtcagcccaaggccaaccccactacgtcactctgttcccgccctcctcactgtacagtctgagccggntggcaaggcgcatagnnnnnnnnnnnnnnnnnnnnnnn

SEQ ID NO: 261685 - DNA, 591 bp, Homo sapiens
  misc_feature: GYAE6OF01ESNST.25.59.F04.1.454.CMB.1.raw
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacggccggttcaccatctccagagacaacgccgacgactttctctttctgcaaatgaacagcctcagagccgaggacacggctgtttatttctgtgcgagaggagtgggcgaaaactggcgtctacggaggtgatgcttttgatttcgtggggcctaagggactagtggtctaccgtctcttcacgcctccaccaagggcccacgtccggtccttcccccgtggaccgccctcgcctccgacggacgccacccgtccggacgacgccacgtacgcccggacccgtcggggcctccggccgtcggtcgaacggtacctaccttcccgtacctggtacctacggtaccgtggacggtcgggctaccgggg

SEQ ID NO: 261686 - DNA, 828 bp, Homo sapiens
  misc_feature: GYAE6OF01CC62S.25.59.F04.1.454.CMB.1.raw
  modified_base (283)..(283): a, c, t, g, unknown or other
  misc_feature (283)..(283): n is a, c, g, or t
tcagactgtacagtcacgaccggtgctcgatttagtacacacacttagggattgggaggcctggtcaagcctgggggggtcccgaagactctcttgtgcagcctctggattcaacttcaaaggctacagcatgaactggatccgccaggcgtccggggaagggtctgcagtggatttcatccattagtggtcttaagcgtagactaaatttttatgcagtacgtcggtagaacggtccggttacacatctaccagacgacacgccgacgtactttctctttcncgacaaatacgaacacgcctacgacgacggaccggaggaccgacggtcttagttttactttcgtggtcggacggtagggaggtaggtagggaacgtaaacgtcggactacgtacggggaggtagtagttcgttacgtttaggtaccggtttacgggtcggggtaacgtaacgggtaacttacggttcggtaccgtaccggtttccttaccgtttacccggaccgttacccccgtaacccgtaacccggtaaccgggtaccccgtacggtttacccccgggtttccccttccccccgggtacgggtcccccggtaccccgttccggtacccgttaaccccggaacggggtacccgtacccgtaaccccggtaccgggaacggacccgtaacccgaaccgaccgggtccccgggtcccggttacgggcccgttccgggacccggttacggtaaaccggaaaccgttaccgttaaccccgttccggtaaaccttacgggtaacccttcgggttaaccaccggggtacgggtcgggtccggtaaccggg

SEQ ID NO: 261687 - DNA, 587 bp, Homo sapiens
  misc_feature: GYAE6OF01E4VGA.25.59.F04.1.454.CMB.1.raw
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacggccggttcaccatctccagagacaaccgccgacgtacttttctcttctgcaaatgaacagcctcagagccgagacacggctgtttatttctgtgcgagaggagtgggacgaaaactggctacgtacggaggtgatgtcttttgtatttcgtggggccgtaaagggacttagtggtcctaccgtcttctcacgtcctaccaccgaacggcccacgtccggttcccttccccgtggccgtccctcgcctccgaggccgcnccgtccgacgacgacacncgccggcccgtggctcgccgtcggtaccgaacggtacccttaccgtccacgttacgtactacgtcgtagcggtcgggcgtacggg

SEQ ID NO: 261688 - DNA, 771 bp, Homo sapiens
  misc_feature: GYAE6OF01DVNTB.25.59.F04.1.454.CMB.1.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (358)..(358): a, c, t, g, unknown or other
  misc_feature (358)..(358): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctcggggaaggtctgcagtgatttcatccattagngtctagngtgacaaattttngcagactggtagaacggtcggttcactatcgtccagacacaacggccacgtacttttcgtactttcagactaaaattcgaaacncggtccctacgagacgacccggtaggaccgaaccgggtcctttaggttttactttaccgtggttcggacccggtaagggtaggggtaggttacggggaccgtaaaaaccgtcgggtaccgttacgtaaccgggaagggttacggtacgttacggtaccgttttttaggtacgtttttacggtacgggggtaccgtaaacggggtacgttaacggttcgggttaccgtaacccggttccgtttacctttacccggtaccgtaccccgttaccgacccggtaaaccggggtaccccttaaccgttcccgggttacccctttccccccgggttcgggtaccccggtcccccgtacgggtaccctaccccggtaacgggaccgtaccccgtaccccggtacccggtaagaacccggg

SEQ ID NO: 261689 - DNA, 744 bp, Homo sapiens
  misc_feature: GYAE6OF01CTMRW.25.59.F04.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (368)..(368): a, c, t, g, unknown or other
  misc_feature (368)..(368): n is a, c, g, or t
  modified_base (654)..(654): a, c, t, g, unknown or other
  misc_feature (654)..(654): n is a, c, g, or t
tcagactgtacagtcacgaccggtgctcgatttagtacacacacttagggattggggctccgctgggttttccttgtcgctattttagaaggtgtccagtgtgaggtgtgctggtgagtcgtgggggagcctggtcaagccgtgggggtcccaagctctcttgtgccagcctcgtggattcaacttcaaaggctanagcagtcaacgtggatcccgccaggccgttaccggggaaggtctgactaggtgtctttacacttcaatttaggtggttactttaaggcgtagtaacctaagttttcngcagaccgtcgtaggaccggtccgttcactctacncagcgtacacgcgtactctttctaccgttnacacaagtcgaactccggtctacgaggacgccggtatacgtacggtctttagtttacttcgaggtcgtacggaggtagggtacgacgggtaaccgtaacgtcggtaccgtaggttaccgggaaggttgtaagtttccgtttcgtttacggtaccgttttgggacccgggtaaccggtaaggaccgttttcgtcggttaacccgttccggttcttacggtccgtaccgtccctacggtacccggaaaccggttccctaccggtttccgttcccccgggtttacccgnggggttaccccctaccctttaccgggaccccgttccgggaacgttacccccggacccggttaaacccccggtcggtaaacggcccccggg

SEQ ID NO: 261690 - DNA, 157 bp, Homo sapiens
  misc_feature: GYAE6OF02FXEJN.25.59.F04.1.454.CMB.1.raw
  modified_base (157)..(157): a, c, t, g, unknown or other
  misc_feature (157)..(157): n is a, c, g, or t
tcagactgtacagtcacgaccggtgctcgatttagtacacacacttagggattgggaccaaggtcaccgtcctaggtcagcccaaggccaaccccactgtcactctgttcccgccctcctcactgtacagtctgagcgggctggcaaggcgcatagn

SEQ ID NO: 261691 - DNA, 161 bp, Homo sapiens
  misc_feature: GYAE6OF02FP8RK.25.59.F04.1.454.CMB.1.raw
  modified_base (157)..(161): a, c, t, g, unknown or other
  misc_feature (157)..(161): n is a, c, g, or t
tcagactgtacagtcacgaccggtgctcgatttagtacacacacttagggattgggaccaaggtcaccgtcctaggtcagcccaaggccaaccccactgtcactctgttcccgccctcctcactgtacagtctgagcgggctggcaaggcgcatagnnnnn

SEQ ID NO: 261692 - DNA, 514 bp, Homo sapiens
  misc_feature: GYAE6OF02IP5G2.25.59.F04.1.454.CMB.1.raw
  modified_base (292)..(292): a, c, t, g, unknown or other
  misc_feature (292)..(292): n is a, c, g, or t
  modified_base (443)..(443): a, c, t, g, unknown or other
  misc_feature (443)..(443): n is a, c, g, or t
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacggccggttcaccatctccagagacaacgccgacgactttctctttctgcaaatgaacagcctcaganccgaggacacggctgtttatttctgtgcgagaggagtgggcgaaaactggctctacggaggtgatgcttttgatttctggggccaagggactatggtcacgtctcttcagcctcacaaggccatcggtctcccctgcgccctgctccaggncacctccgagagcacagccggcctgggctgctcggtcaaggctactcactgtacngtctgacgcggntcgg

SEQ ID NO: 261693 - DNA, 180 bp, Homo sapiens
  misc_feature: GYAE6OF02HR8GJ.25.59.F04.1.454.CMB.1.raw
  modified_base (161)..(180): a, c, t, g, unknown or other
  misc_feature (161)..(180): n is a, c, g, or t
tcagactgtacagtcacgaccggtgctcgatttagtacacacacttagggattgggaccaaggtcaccgtcctaggtcagcccaaggccaaccccactgtcactctgttcccaccctcctcactgtaccagtctgagcgggtctggcaaggcgctattagnnnnnnnnnnnnnnnnnnnn

SEQ ID NO: 261694 - DNA, 727 bp, Homo sapiens
  misc_feature: GYAE6OF02H0CBB.25.59.F04.1.454.CMB.1.raw
  modified_base (299)..(299): a, c, t, g, unknown or other
  misc_feature (299)..(299): n is a, c, g, or t
tcagactgtacagtcacgaccggtgctcgatttagtacacacacttagggattggggcctacccgctgggttttcccttgtcgctattttagaacggtcgtccagtgtgaggtggtgctgggtggagtctgggggaggcctggtcaagcgtgggggtcccgaagactctcttgtgcagcctctggattacaacttcaaaggctacagcatgaactggactccgcaggcgtaccggggaaggtctgcaggtggtatttcactccattacgtggtcttaaggcgtgaacgtaaattttagngcagtactcggtagaaccgggtccggtttcaaccctagttccgtaccaaggaacgaacgaaaccgcccgaaccgtaacttttccttctttcgtaggtacctaaatcgaaacacgcctacgagacgcgaaggacacggcttgtttatttcgtagtgacgaacgaggtaggtacgggaacgaaacgtcgggactacggtacgggtaggtgtagttgttcgttttagaagttttcgacggggacctaaggggtaccttaggtccggttaccacccggtttcttaccgttcgaccgttccccgttacgaacccggtaacggggaccccctaggttccccggtttccccgttacccccggtcggtcccgtaccccgttcgtacccgtacccggacgggacctaccccgtacccggttccccggagtaacccgg

SEQ ID NO: 261695 - DNA, 543 bp, Homo sapiens
  misc_feature: GYAE6OF02IJL4S.25.59.F04.1.454.CMB.1.raw
  modified_base (429)..(429): a, c, t, g, unknown or other
  misc_feature (429)..(429): n is a, c, g, or t
tcagactgtacagtcacgaccggtgctcgatttagtacacacacttagggattggggctccgctgggtttccttgtcgctattttagaaggtgtccagtgtgaggtggtgctggtggagtctgggggaggcctggtcaagcctgggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacgccggttcaccatctccagagacaacgccgacgactttctctttctgcaaatgaacagcctcagagccgaggacacggctgtttattctgtgcgtagaggagtgggcgaaaactggctctacggaggtgatgtnttttgatttcgtgggccaagggactagtggtcaccgtctcttcagcctaccaccaagggcccatccggtccttccccctggccgccctgcctccaggacgccacctccgagacg

SEQ ID NO: 261696 - DNA, 158 bp, Homo sapiens
  misc_feature: GYAE6OF02IAI1T.25.59.F04.1.454.CMB.1.raw
  modified_base (157)..(158): a, c, t, g, unknown or other
  misc_feature (157)..(158): n is a, c, g, or t
tcagactgtacagtcacgaccggtgctcgatttagtacacacacttagggattgggaccaaggtcaccgtcctaggtcagcccaaggccaaccccactgtcactctgttcccgccctcctcactgtacagtctgagcgggctggcaaggcgcatagnn

SEQ ID NO: 261697 - DNA, 762 bp, Homo sapiens
  misc_feature: GYAE6OF02JLW1E.25.59.F04.1.454.CMB.1.raw
  modified_base (210)..(210): a, c, t, g, unknown or other
  misc_feature (210)..(210): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgactaattttangcagactcggtagaacggccggttcaccatctccagagacaacgccgacgtacttctctttctgcaaatgaacagcctcagagccgaggacacggctgtttattctgtgcgtagaggagtgggacgaaaacgtggctcgtacggaggtgagtagtcgttttagtagtttcgtcggggaccgtaagggtacttaagtcggtaccgtacccgttcgttccgttaccgtacgtccccgttaccaacccggtaaccgggtcccgtaacgttcccggttccctttccccccgtcgggtccccgtccccgttccggcccgttaccccggtaacgggaccggtaccccgtaacccgttaccccggaacggtacccgacccgaaacccggccggaccccgggtaccccgggtaccggggtaccgttacccggtccccggtttacggggtacccgtaaacggggttaccctttaacccggtttaccccgtaaccgttacggttaaccctacgggttacccgtttacgggaaccggggttcccgggtaccgtaacccggggg

SEQ ID NO: 261698 - DNA, 158 bp, Homo sapiens; identical to SEQ ID NO: 261696
  misc_feature: GYAE6OF02FOV1M.25.59.F04.1.454.CMB.1.raw
  modified_base (157)..(158): a, c, t, g, unknown or other
  misc_feature (157)..(158): n is a, c, g, or t

SEQ ID NO: 261699 - DNA, 588 bp, Homo sapiens
  misc_feature: GYAE6OF02H5NLC.25.59.F04.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
  modified_base (398)..(398): a, c, t, g, unknown or other
  misc_feature (398)..(398): n is a, c, g, or t
  modified_base (452)..(452): a, c, t, g, unknown or other
  misc_feature (452)..(452): n is a, c, g, or t
  modified_base (567)..(567): a, c, t, g, unknown or other
  misc_feature (567)..(567): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggagcctggtcaagcctggggggtcccgaagactctcttgtgcagcctctggattcaactttcaaaggctacagcatgaactggatccgcaggctcgggaaggtctgcagtgatttcatccattagtggtcttaagcgtgactaaattttangcagctcggtagaacggccggttnaccatctccagacgacaacgccgaacgacttttctctttcngctaaatgaacngcctacagagccgaggaccacggcttgtttattctgtgcgagnggagtggacgaaacgtggacgtcgtacggaggtgtagtgtctttgtatttcggngggtaccgtagggactagtcggtacaccgttctctcgacgtcctaccgaaccgtacggccacgttccggttcccgttccccgtacggtcctccccgtcgccgttccgacggaccnccgtaccctccggaggtaccg

SEQ ID NO: 261700 - DNA, 598 bp, Homo sapiens
  misc_feature: GYAE6OF02IWPDL.25.59.F04.1.454.CMB.1.raw
  modified_base (283)..(283): a, c, t, g, unknown or other
  misc_feature (283)..(283): n is a, c, g, or t
  modified_base (345)..(345): a, c, t, g, unknown or other
  misc_feature (345)..(345): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccgggggaaggtctgcagtggatttcatccattagtggtcttaagcgtgactaaattttangcagactcggtgaacggccgttcaccatctccagagacaacgccgacgtactttctctttcngacaaatcgaacagcctacagacgccgaaggacacggcttgtttatttctgtgcgagaggaggtgggacgaaaacgtggctacgtacggaggtgatgtcttttgtacgtttcgtgggaccgaacgggtactagtggtccgtaccgtcttcttcgacgccctaccgaaccgaacggccctacgtccggttcccgttcccccgtcggcccgtcccgtcgtcctccgacggaccgacctacccgtccgacgaccgg

SEQ ID NO: 261701 - DNA, 692 bp, Homo sapiens
  misc_feature: GYAE6OF02HTHQK.25.59.F04.1.454.CMB.1.raw
  modified_base (218)..(218): a, c, t, g, unknown or other
  misc_feature (218)..(218): n is a, c, g, or t
tcagactgtacagtcacgaccggtgctcgatttagtacacacacttagggattggggaggcctggtcaagcctggggggtcccgaagacgtctcttggtgccagcctctggattcaactttcaaaggctacagcatgaactggatccgccaggctccggggaaggttctgcagtggatttcatccattagtggtcttaagcgtgacgaaaatttttangcagacttcggtgaacggccgggttcaccatcgtcagagacaacgccgacgtacttttcgtctttactagtacaaatgaacacgcctcacgagccgtaggacacggctagtttactttctagtgcgagaggaggtgggtacgaaaacgtggtacgttcgtaacggaggtgaagttgtcgttttggagtttcgtacggggtacctaagggtacttagttcggtacgtaccgttcttacgttcacggtcccgtaccgtaaccgaacgggtaccctaagttccggtaccgtttccccgttacggtcccgtcccgttcgtacccgtcccgacggtaccgccgtacccgttaccggacgtaccgcgtaccgtacggcccgggtaccgtcggggacctcggtccgtaggtaccgaacggtaccgttaccgttccgaccgttcgttaccgtacgtccgtacggacgtccgggtcgtacggg

SEQ ID NO: 261702 - DNA, 536 bp, Homo sapiens
  misc_feature: GYAE6OF02FV3KY.25.59.F04.1.454.CMB.1.raw
  modified_base (445)..(445): a, c, t, g, unknown or other
  misc_feature (445)..(445): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaagggtctgcagtggatttcatccattagtggtcttaagcgtgacaaattttatgcagactcggtgaacggccggttcaccatctccagagacaacgccgacgactttctcttctgcaaatgaacagcctcagagccgaggacacggctgtttatttctgtgcgagagagtggcgaaaactggctctacggaggtgattctttgatttctggggccaagggactatggtcaccgtctcttcagcctcaccaagggcccatcgtctcccctggcgccctgctccgaggcnccacctccgagacgcaccgagccggccctcgggctgccctgggtccaagggcctaccttccgactgtacacgtctggagcgggctggaccg

SEQ ID NO: 261703 - DNA, 581 bp, Homo sapiens
  misc_feature: GYAE6OF02JZ5D5.25.59.F04.1.454.CMB.1.raw
  modified_base (209)..(209): a, c, t, g, unknown or other
  misc_feature (209)..(209): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (573)..(573): a, c, t, g, unknown or other
  misc_feature (573)..(573): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaaggtctgcagtggatttcatccattagtggtcttaagcgtgactaaattttngcagactcggtgaacggccgttcaccatctccagagacaacgccgacgactttctcttctgcaaatgaacagcctcagagcgagacacggctgtttattctgtgcgtagaggagtgggacgaaaacgtggactcgtacggagtgatgtctttgatttcgngggcaaggactgtcgtcaccgtntctcacncctcgaccgacggcctactccggtcctccccgtggcctcccgtcgcctccgaggtaccgccacccgtccgacgtacgcacgacgccggcccgtgggcctaccgccgttggtaccgaacgggtaccttaccgtaccgacgttacggtacgtacggtccgtaggacggtaccgggngtaccggg

SEQ ID NO: 261704 - DNA, 161 bp, Homo sapiens
  misc_feature: GYAE6OF02IAZZX.25.59.F04.1.454.CMB.1.raw
  modified_base (157)..(161): a, c, t, g, unknown or other
  misc_feature (157)..(161): n is a, c, g, or t
tcagactgtacagtcacgaccggtgctcgatttagtacacacacttagggattgggaccaaggtcaccgtcctaggtcagcccaaggccaaccccactgtcactctgttcccaccctcctcactgtacagtctgagcgggctggcaaggcgcatagnnnnn

SEQ ID NO: 261705 - DNA, 628 bp, Homo sapiens
  misc_feature: GYAE6OF02GTM43.25.59.F04.1.454.CMB.1.raw
  modified_base (208)..(208): a, c, t, g, unknown or other
  misc_feature (208)..(208): n is a, c, g, or t
  modified_base (274)..(274): a, c, t, g, unknown or other
  misc_feature (274)..(274): n is a, c, g, or t
  modified_base (510)..(510): a, c, t, g, unknown or other
  misc_feature (510)..(510): n is a, c, g, or t
  modified_base (541)..(541): a, c, t, g, unknown or other
  misc_feature (541)..(541): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccgccaggctccggggaaggtctgcagtggatttcatccattagtggtcttaagcgtgacaaattttngcagactcggtgaacggccggttcaccatcctccgagagaccaacgccgacgtactttctctttcngacaaatgaacacggcctcgagcgccgaggacacggcttgtttatttcgtgttgcgagaggaggtgggaacgtaaacgtggacttcgtacggaggtgagtgtcttttgacttttcggcggggtaccgaagggtactaggtcgtacaccgttcgtcttcgacgtcctaccaccggaacggtcccaacgttccgttacccttccccgtaggtcccgtccgtcgtccctacgacggacnccgaccgtcgacgcgcacgtcgccggtccgnggcctcgtccgtggtaccgaacggtaccttacccgtacgtacgttacggtactacggttcgtacgggacggtccgggtcgtaacggg

SEQ ID NO: 261706 - DNA, 666 bp, Homo sapiens
  misc_feature: GYAE6OF02GRMO0.25.59.F04.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (510)..(510): a, c, t, g, unknown or other
  misc_feature (510)..(510): n is a, c, g, or t
  modified_base (578)..(578): a, c, t, g, unknown or other
  misc_feature (578)..(578): n is a, c, g, or t
tcagactgtacagtcacgaccggtgctcgatttagtacacacacttagggattggggctccgctgggttttccttgtcgctatttttagaaggtgtccagtgtgaggtggtgctggtggagtctgggggaggcctggtcaagcctggggggtcccgaagactctcttgtgcagcctctggattcaacttcaaaggctacagcatgaactggactccgccaggcctccgggggaagggtctgcagtggntttcatccattagtggtcttaagcgtgacaaattttatgcagaccttcggtggaaaccggtcccgggttcaaccctatcctccaggacgacaaccgccgacgtactttctctttcngcaaatgaacngcctanacggacgccggacgacaccggctttggtttactttcgtgtacggcggaacggtggacgggtgggaaccggaaaacgtgggaccttacgtaacggggtggttacgagttcgttacttttggtagtttcgnggggtacagggtacttagtcgtaccgtaccgtctcttcgacgtccccttaccgacgtaccggtacccncgttcccggttacccttccccggtacggcccccgtcccgtccgtccgtccggtacggtaccgacccgtacccgtccgaggtaacccgg

SEQ ID NO: 261707 - DNA, 666 bp, Homo sapiens
  misc_feature: GYAE6OF02FMEB6.25.59.F04.1.454.CMB.1.raw
  modified_base (143)..(143): a, c, t, g, unknown or other
  misc_feature (143)..(143): n is a, c, g, or t
  modified_base (210)..(210): a, c, t, g, unknown or other
  misc_feature (210)..(210): n is a, c, g, or t
  modified_base (466)..(466): a, c, t, g, unknown or other
  misc_feature (466)..(466): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagcatgaactggatccncaggctcggggaaggtctgcagtggatttcatccgattagtggtcttaagcgtagactaaattttcngcagtactcggtagaaccggtccgttcaccagttcctcagaacacctaaccgccgtagttacctttcttactttcgtctacctaatacgaacgtacgtcctacgacgtacggaccggaggacaccggtcttgtttacttcgtgtcgacgaggaggtaggttcgggaacgtaaacgtggaccgtaggtacggacggtgtacgtcgttctttaggtaccgttcggttacgggacgtaggtacgtgtacggtctccgtntactcggtctcgtaccgacgtcctacgtacgttccgtcccgttcccgtacgcccggtctacggtccctaccgtagccgtacgacggtccgacgtaccgacgacgaccgtccgccggtcgtccgccgtccggtaggtcgtaacgggtccttaacctccgttaacgtcgtaacgtcgtcggtaacggtcggaccttcgggcg

SEQ ID NO: 261708 - DNA, 668 bp, Homo sapiens
  misc_feature: GYAE6OF02GCCNY.25.59.F04.1.454.CMB.1.raw
  modified_base (285)..(285): a, c, t, g, unknown or other
  misc_feature (285)..(285): n is a, c, g, or t
  modified_base (613)..(613): a, c, t, g, unknown or other
  misc_feature (613)..(613): n is a, c, g, or t
tcagactgtacagtcacgaccggtgctcgatttagtacacacacttagggattggggctccgctggggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccgggggaaggtctgcagtggatttcatccattagtggtcttaagcgtagactaaattttangcagtactcgggtagaaccggccggttcaccatctccagagacaaccgccgacgtcttttctctttctgacaaatcgaacacgtcctacaggacgaccggaggaccgacgggtctttagttttactttcgtaggttcgacggtaaggagggtaggtacgggaacgtaaaacggtggtaccttcggtaacggggaggttagtattggttacgttttacgtacttttcgggcgggtacgtaagggtacttagtcggttacctaccgttcttaccgttcacgtccctaccgaaccgtaccggtccctacgttcccggttcccttccccggnggtccccgtcccgtcgtacccgtcgacggcctcccgtacccgtacgacgtaccgg

SEQ ID NO: 261709 - DNA, 682 bp, Homo sapiens
  misc_feature: GYAE6OF02JL60H.25.59.F04.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (610)..(610): a, c, t, g, unknown or other
  misc_feature (610)..(610): n is a, c, g, or t
tcagactgtacagtcacgaccggtgctcgatttagtacacacacttagggattgggaggcctggtcaagcctggggggtcccgaagactctcttgtgcagcctctggattcaacttcaaaggctacagccatgaactggatcccgccaggccgtccggggaagggtctgcagtggatttcatccattagtggtctaagcgtgactaatttangcagtactggtagacggccgttcaccntctaccagacgacacgccgactactttctacttcanacaaatgaactcgacctagacgacgtccggacgaacgtacggtctttagttacgttcgtgttcgacggtacggaggtacgggacggtaacgaacgtcggtactacgggtacggtaagtcgtggttacgtaggtttacgttacggtttacggtcggacggtaacgttagtagttaccgtcgtaccggttctccgttacctaccgccccgtaaccgaccggaccggttccacggttaccgtccccgtaccgtccggtcccgtacccgttcgacccgtacgaccggtcgtacccgaccgtacgaccgtacgtccgaaccgcggtacccgtcccggtanccggtacgcggttaccgacgtacgtaccgttcctacgaccgttgtacgacttcgaggcgtacgtcggtaacg

SEQ ID NO: 261710 - DNA, 666 bp, Homo sapiens
  misc_feature: GYAE6OF02INZ9C.25.59.F04.1.454.CMB.1.raw
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccatttagtggtcttaaagcgttagacaaaatttttangcagtactcggtgaacggccggttcaccactctccagagacaacgccgacgacttttctctttcngtacaaaatgaaacagccctacagacgccggagacacggtcttgtttattctgtgcgagaggagtgggacgaaacgtggactacgtacggaggtgtatcggttcttttagtacttttcggacggggtaccgtaaacggggtacttaagttacggttccgtaaccggttcttaccgttcctacggtcccctaacccgaacccgaacggggtacccctacgtcccggttaccccgtttcccccggtacgggccccgtccccgttcgtcccgttacccgaccgggtacgtcccgtacccgttaccggacgtaaccgg

SEQ ID NO: 261711 - DNA, 855 bp, Homo sapiens
  misc_feature: GYAE6OF02GA0ER.25.59.F04.1.454.CMB.1.raw
  modified_base (445)..(445): a, c, t, g, unknown or other
  misc_feature (445)..(445): n is a, c, g, or t
  modified_base (488)..(488): a, c, t, g, unknown or other
  misc_feature (488)..(488): n is a, c, g, or t
  modified_base (509)..(509): a, c, t, g, unknown or other
  misc_feature (509)..(509): n is a, c, g, or t
tcagactgtacagtcacgaccggtgctcgatttagtacacacacttagggattggggctccgctgggttttccttgtcgctattttagaaggtgtccagtgtgaggtggtgctggtggagtctgggggaggcctggtcaagccgtggggggtcccaagactctcttgtgcagccctctaggtacttcctaacttcgaaaaggtcctaacacgctaagtcgtaacgtgacgtccgcccgagggccgtaccgggggtaaggtctcgcgaggtggtactttaccgacttccgtaatttggttacgggttacttaaacggtccggtacgtaactaaaaatttttgtacgccgtaagtaccgtcgggttacggaaccggtccggttaccaaccctcgttaccctaccaaggtaacgaccgaaccggccggtaaccttacttttcccgttnttttccgagtaacctaaagtacgtaacacgtccacgtacgacncccggggaatcccgacggttntttatttaccgttatgggtacgtacggaaagggtacgggtacggtaacgggtaacgggtaaacctcgggtacccgttaacggtacgggggtaagtttaggtccttagggtttcgttttaacgttacggtttacggtacgggggtaccgtaagggtttacttcggtaaccggtccgttaccgttccgttactacccgacgccctaacccggaaccgttaaccgggtcccgttaaccggttccccgtttaccccggtcccccggggttaccgaccccgttcccggttaccacccggttaaccggaccggtaccgtaccccggaacccggttccggaaccggtaacccg

SEQ ID NO: 261712 - DNA, 128 bp, Homo sapiens
  misc_feature: GYAE6OF01A6KBW.21.78.H01.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagtgtgagtagtttgggttggcacagcggccctgggctgcctggtcaaggactacttcccgagcgacgactgagcgggctggcaaggcgcatagn

SEQ ID NO: 261713 - DNA, 127 bp, Homo sapiens
  misc_feature: GYAE6OF01CMY89.21.78.H01.1.454.CMB.1.raw
  modified_base (126)..(127): a, c, t, g, unknown or other
  misc_feature (126)..(127): n is a, c, g, or t
tcagtcgtcgctcgcacgaccggtgctcgattagtgtgagtagttggttgggcacagcggccctgggctgcctggtcaaggactacttccctcgtctctactgagcgggctggcaaggcgcatagnn

SEQ ID NO: 261714 - DNA, 171 bp, Homo sapiens
  misc_feature: GYAE6OF01BS7XP.21.78.H01.1.454.CMB.1.raw
  modified_base (171)..(171): a, c, t, g, unknown or other
  misc_feature (171)..(171): n is a, c, g, or t
tcagtcgtcgctcgcacgaccggtgctcgatttagtgtgagtagtttgggtttggggaagaggaagactgacggtccccaggagttcaggtgctgggcacagcggccctgggctgcctggtcaaggactacttccctcgtctctactgagcgggctggcaaggcgcatagn

SEQ ID NO: 261715 - DNA, 130 bp, Homo sapiens
  misc_feature: GYAE6OF01BIWVW.21.78.H01.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagn

SEQ ID NO: 261716 - DNA, 129 bp, Homo sapiens
  misc_feature: GYAE6OF01A9Y2I.21.78.H01.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagtgtgagtagtttgggttgggcacagcggccctgggctgcctggtcaaggactacttccctcgtctctactgagcgggctggcaaggcgcatagn

SEQ ID NO: 261717 - DNA, 130 bp, Homo sapiens; identical to SEQ ID NO: 261715
  misc_feature: GYAE6OF01BDOFI.21.78.H01.1.454.CMB.1.raw
  modified_base (130)..(130): a, c, t, g, unknown or other
  misc_feature (130)..(130): n is a, c, g, or t

SEQ ID NO: 261718 - DNA, 127 bp, Homo sapiens
  misc_feature: GYAE6OF01ASSOB.21.78.H01.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagtgtgagtagttggttggcacagcggccctgggctgcctggtcaaggacctacttcactcgtctctactgagcgggctggcaaggcgcatagn

SEQ ID NO: 261719 - DNA, 126 bp, Homo sapiens
  misc_feature: GYAE6OF01A44II.21.78.H01.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagtgtgagtagttggttggcacagcggccctgggctgcctggtcaaggactacttccctcgtctctactgagcgggctggcaaggcgcatagn

SEQ ID NO: 261720 - DNA, 129 bp, Homo sapiens
  misc_feature: GYAE6OF01BWNF1.21.78.H01.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagtgtgagtagtttgggtttggcacagcggccctgggctgcctggtcaaggactacttccctcgtctctactgagcgggctggcaaggcgcatagn

SEQ ID NO: 261721 - DNA, 173 bp, Homo sapiens
  misc_feature: GYAE6OF01CNGXH.21.78.H01.1.454.CMB.1.raw
  modified_base (171)..(173): a, c, t, g, unknown or other
  misc_feature (171)..(173): n is a, c, g, or t
tcagtcgtcgctcgcacgaccggtgctcgatttagtgtgagtagtttgggtttggggaagaggaagactgacggtccccaggagttcaggtgctgggcacagcggccctgggctgcctggtcaaggactacttcccgagcgacgactgagcgggctggcaaggcgcatagnnn

SEQ ID NO: 261722 - DNA, 173 bp, Homo sapiens
  misc_feature: GYAE6OF01DKVS6.21.78.H01.1.454.CMB.1.raw
  modified_base (172)..(173): a, c, t, g, unknown or other
  misc_feature (172)..(173): n is a, c, g, or t
tcagtcgtcgctcgcacgaccggtgctcgatttagtgtgagtagtttgggtttggggaagaggaagactgacggtcccccaggagttcaggtgctgggcacagcggccctgggctgcctggtcaaggactacttccctcgtctctactgagcgggctggcaaggcgcatagnn

SEQ ID NO: 261723 - DNA, 131 bp, Homo sapiens
  misc_feature: GYAE6OF01CE0TM.21.78.H01.1.454.CMB.1.raw
  modified_base (130)..(131): a, c, t, g, unknown or other
  misc_feature (130)..(131): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnn

SEQ ID NO: 261724 - DNA, 135 bp, Homo sapiens
  misc_feature: GYAE6OF01DY5R6.21.78.H01.1.454.CMB.1.raw
  modified_base (131)..(135): a, c, t, g, unknown or other
  misc_feature (131)..(135): n is a, c, g, or t
tcagtcgtcgctcgcacgaccggtgctcgatttagtgtgagtagtttgggtttgggcgacagcggccctgggctgcctggtcaaggactacttcccgagcgacgactgagcgggctggcaaggcgcatagnnnnn

SEQ ID NO: 261725 - DNA, 130 bp, Homo sapiens
  misc_feature: GYAE6OF01A3GFA.21.78.H01.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagtgtgagtagtttgggtttggtcacagcggccctgggctgcctggtcaaggactacttccctcgtctctactgagcgggctggcaaggcgcatagn

SEQ ID NO: 261726 - DNA, 131 bp, Homo sapiens; identical to SEQ ID NO: 261723
  misc_feature: GYAE6OF01CD8GV.21.78.H01.1.454.CMB.1.raw
  modified_base (130)..(131): a, c, t, g, unknown or other
  misc_feature (130)..(131): n is a, c, g, or t

SEQ ID NO: 261727 - DNA, 129 bp, Homo sapiens; identical to SEQ ID NO: 261720
  misc_feature: GYAE6OF01AG02T.21.78.H01.1.454.CMB.1.raw
  modified_base (129)..(129): a, c, t, g, unknown or other
  misc_feature (129)..(129): n is a, c, g, or t

SEQ ID NO: 261728 - DNA, 146 bp, Homo sapiens
  misc_feature: GYAE6OF01CMFB8.21.78.H01.1.454.CMB.1.raw
  modified_base (131)..(146): a, c, t, g, unknown or other
  misc_feature (131)..(146): n is a, c, g, or t
tcagtcgtcgctcgcacgaccggtgctcgatttagtgtgagtagtttgggtttgggcgacagcggccctgggctgcctggtcaaggactacttccctcgtctctactgagcgggctggcaaggcgcatagnnnnnnnnnnnnnnnn

SEQ ID NO: 261729 - DNA, 129 bp, Homo sapiens; identical to SEQ ID NO: 261720
  misc_feature: GYAE6OF01C66ON.21.78.H01.1.454.CMB.1.raw
  modified_base (129)..(129): a, c, t, g, unknown or other
  misc_feature (129)..(129): n is a, c, g, or t

SEQ ID NO: 261730 - DNA, 130 bp, Homo sapiens; identical to SEQ ID NO: 261715
  misc_feature: GYAE6OF01DDKS1.21.78.H01.1.454.CMB.1.raw
  modified_base (130)..(130): a, c, t, g, unknown or other
  misc_feature (130)..(130): n is a, c, g, or t

SEQ ID NO: 261731 - DNA, 130 bp, Homo sapiens; identical to SEQ ID NO: 261715
  misc_feature: GYAE6OF01CO0NP.21.78.H01.1.454.CMB.1.raw
  modified_base (130)..(130): a, c, t, g, unknown or other
  misc_feature (130)..(130): n is a, c, g, or t

SEQ ID NO: 261732 - DNA, 130 bp, Homo sapiens; identical to SEQ ID NO: 261715
  misc_feature: GYAE6OF01BUO0J.21.78.H01.1.454.CMB.1.raw
  modified_base (130)..(130): a, c, t, g, unknown or other
  misc_feature (130)..(130): n is a, c, g, or t

SEQ ID NO: 261733 - DNA, 132 bp, Homo sapiens
  misc_feature: GYAE6OF01CNRPY.21.78.H01.1.454.CMB.1.raw
  modified_base (129)..(132): a, c, t, g, unknown or other
  misc_feature (129)..(132): n is a, c, g, or t
tcagtcgtcgctcgcacgaccggtgctcgatttagtgtgagtagtttgggtttgggcacagcggccctgggctgcctggtcaaggactacttccctcgttctactgagcgggctggcaaggcgcatagnnnn

SEQ ID NO: 261734 - DNA, 148 bp, Homo sapiens
  misc_feature: GYAE6OF01CS4HI.21.78.H01.1.454.CMB.1.raw
  modified_base (110)..(110): a, c, t, g, unknown or other
  misc_feature (110)..(110): n is a, c, g, or t
  modified_base (131)..(148): a, c, t, g, unknown or other
  misc_feature (131)..(148): n is a, c, g, or t
tcagtcgtcgctcgcacgaccggtgctcgatttagtgtgagtagtttgggtttggcacagcggccctgggctgcctggtcaaggactaccttccctcgtctctactggancgggctggcaaggcgcatagnnnnnnnnnnnnnnnnnn

SEQ ID NO: 261735 - DNA, 509 bp, Homo sapiens
  misc_feature: GYAE6OF01E2AB8.21.78.H01.1.454.CMB.1.raw
  modified_base (130)..(131): a, c, t, g, unknown or other
  misc_feature (130)..(131): n is a, c, g, or t
  modified_base (133)..(134): a, c, t, g, unknown or other
  misc_feature (133)..(134): n is a, c, g, or t
  modified_base (136)..(136): a, c, t, g, unknown or other
  misc_feature (136)..(136): n is a, c, g, or t
  modified_base (140)..(140): a, c, t, g, unknown or other
  misc_feature (140)..(140): n is a, c, g, or t
  modified_base (142)..(142): a, c, t, g, unknown or other
  misc_feature (142)..(142): n is a, c, g, or t
  modified_base (149)..(149): a, c, t, g, unknown or other
  misc_feature (149)..(149): n is a, c, g, or t
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (188)..(189): a, c, t, g, unknown or other
  misc_feature (188)..(189): n is a, c, g, or t
  modified_base (191)..(191): a, c, t, g, unknown or other
  misc_feature (191)..(191): n is a, c, g, or t
  modified_base (193)..(194): a, c, t, g, unknown or other
  misc_feature (193)..(194): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgtgagtagtttgggtttggggcacagcggccctgggctgcctggtcaaggctacttccctgtctctactgagcgggctggcaaggcgcatagcnncnngntgangntcatgcnanatctgnctgnacgngancagctgcagcatgncgnacnncncnnacacgntgngcagctngtcncncngcncgttacnctcgaacntcgtcgtcgcncgaaacgttcgacgacgagcgcntttcgaaanctttacgctcgggtcncgcgaaagtttccngaaacgtcgacctcgactacgcgtacgtacgtacgtacgtacgtcgtacgtacgtacgtacgtacgtacgtacgtacgtacgtacgtacgtacgtacgtacgtacacgcgacgcgtacgcgcgtcgacgtcgtacgtacgacgcgtacgtacgtacgtacgtcgtagtcgtcgacgtcgcgtcgcgacgcgtcgtcgtcg

SEQ ID NO: 261736 - DNA, 204 bp, Homo sapiens
  misc_feature: GYAE6OF01B5KCL.21.78.H01.1.454.CMB.1.raw
  modified_base (177)..(204): a, c, t, g, unknown or other
  misc_feature (177)..(204): n is a, c, g, or t
tcagtcgtcgctcgcacgaccggtgctcgatttagtgtgagtagtttgggtttgggggaaggaggaagactgacggtcccccaggagttcgaggtgctaggcacagcggccctgggcctgcctggtctaaggactacttcccgagcgacgactgagcgggctggcaaggcgcatagnnnnnnnnnnnnnnnnnnnnnnnnnnnn

SEQ ID NO: 261737 - DNA, 164 bp, Homo sapiens
  misc_feature: GYAE6OF01CLZBW.21.78.H01.1.454.CMB.1.raw
  modified_base (130)..(164): a, c, t, g, unknown or other
  misc_feature (130)..(164): n is a, c, g, or t
tcagtcgtcgctcgcacgaccggtgctcgatttagtgtgagtagtttgggtttggggcacagcggccctgggctgcctggtcaaggctacttccctcgtctctactgagcgggctggcaaggcgcatagnnnnnnnnnnnnnnnnnnnnnnnnnnnnnnnnnnn

SEQ ID NO: 261738 - DNA, 132 bp, Homo sapiens
  misc_feature: GYAE6OF01DZBVW.21.78.H01.1.454.CMB.1.raw
  modified_base (130)..(132): a, c, t, g, unknown or other
  misc_feature (130)..(132): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnn

SEQ ID NO: 261739 - DNA, 538 bp, Homo sapiens
  misc_feature: GYAE6OF01ATHXU.21.78.H01.1.454.CMB.1.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcacttattatagtggtggtaccacatactacacagactccgtgaagggccgattcaccatctcagaagacaattccaggaacacattgtatcttacaaatgaataacctgagagccgaggacacgggccatgtatactgtgtgggcatttacgtgaccccgtggggcccgggaacccgtggtccaccgtctccccaccctccgaccaacggg

SEQ ID NO: 261740 - DNA, 203 bp, Homo sapiens
  misc_feature: GYAE6OF01EF32U.21.78.H01.1.454.CMB.1.raw
  modified_base (173)..(203): a, c, t, g, unknown or other
  misc_feature (173)..(203): n is a, c, g, or t
tcagtcgtcgctcgcacgaccggtgctcgatttagtgtgagtagttgggtttgggggaagaggaagactgacggtcccccaggagttcaggtgctgggccacagcggccctgggctgcctggtcaaggtctacttccctgtctctactgagcgggctaggcaaggcgcatagnnnnnnnnnnnnnnnnnnnnnnnnnnnnnnn

SEQ ID NO: 261741 - DNA, 131 bp, Homo sapiens
  misc_feature: GYAE6OF01CFS9I.21.78.H01.1.454.CMB.1.raw
  modified_base (130)..(131): a, c, t, g, unknown or other
  misc_feature (130)..(131): n is a, c, g, or t
tcagtcgtcgctcgcacgaccggtgctcgatttagtgtgagtagtttgggtttgggcacagcggccctgggctgcctggtcaaggactacttcccgagcgacgactgagcgggctggcaaggcgcatagnn

SEQ ID NO: 261742 - DNA, 173 bp, Homo sapiens
  misc_feature: GYAE6OF01DQROS.21.78.H01.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttcccgagcgacgactgagcgggctggcaaggcgcatagn

SEQ ID NO: 261743 - DNA, 130 bp, Homo sapiens; identical to SEQ ID NO: 261715
  misc_feature: GYAE6OF01AK14W.21.78.H01.1.454.CMB.1.raw
  modified_base (130)..(130): a, c, t, g, unknown or other
  misc_feature (130)..(130): n is a, c, g, or t

SEQ ID NO: 261744 - DNA, 130 bp, Homo sapiens; identical to SEQ ID NO: 261715
  misc_feature: GYAE6OF01B0ZFO.21.78.H01.1.454.CMB.1.raw
  modified_base (130)..(130): a, c, t, g, unknown or other
  misc_feature (130)..(130): n is a, c, g, or t

SEQ ID NO: 261745 - DNA, 130 bp, Homo sapiens; identical to SEQ ID NO: 261715
  misc_feature: GYAE6OF01CWAM5.21.78.H01.1.454.CMB.1.raw
  modified_base (130)..(130): a, c, t, g, unknown or other
  misc_feature (130)..(130): n is a, c, g, or t

SEQ ID NO: 261746 - DNA, 130 bp, Homo sapiens; identical to SEQ ID NO: 261715
  misc_feature: GYAE6OF01CFEXP.21.78.H01.1.454.CMB.1.raw
  modified_base (130)..(130): a, c, t, g, unknown or other
  misc_feature (130)..(130): n is a, c, g, or t

SEQ ID NO: 261747 - DNA, 174 bp, Homo sapiens
  misc_feature: GYAE6OF01BZR1P.21.78.H01.1.454.CMB.1.raw
  modified_base (173)..(174): a, c, t, g, unknown or other
  misc_feature (173)..(174): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttccctcgtctctactgagcgggctggcaaggcgcatagnn

SEQ ID NO: 261748 - DNA, 130 bp, Homo sapiens; identical to SEQ ID NO: 261715
  misc_feature: GYAE6OF01C8WTI.21.78.H01.1.454.CMB.1.raw
  modified_base (130)..(130): a, c, t, g, unknown or other
  misc_feature (130)..(130): n is a, c, g, or t

SEQ ID NO: 261749 - DNA, 132 bp, Homo sapiens; identical to SEQ ID NO: 261738
  misc_feature: GYAE6OF01E0WI2.21.78.H01.1.454.CMB.1.raw
  modified_base (130)..(132): a, c, t, g, unknown or other
  misc_feature (130)..(132): n is a, c, g, or t

SEQ ID NO: 261750 - DNA, 141 bp, Homo sapiens
  misc_feature: GYAE6OF01BPU0S.21.78.H01.1.454.CMB.1.raw
  modified_base (130)..(141): a, c, t, g, unknown or other
  misc_feature (130)..(141): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnnnnnnn

SEQ ID NO: 261751 - DNA, 130 bp, Homo sapiens
  misc_feature: GYAE6OF01BNTE8.21.78.H01.1.454.CMB.1.raw
  modified_base (129)..(130): a, c, t, g, unknown or other
  misc_feature (129)..(130): n is a, c, g, or t
tcagtcgtcgctcgcacgaccggtgctcgatttagtgtgagtagtttgggttgggcacagcggccctgggctgcctggtcaaggactacttccctcgtctctactgagcgggctggcaaggcgcatagnn

SEQ ID NO: 261752 - DNA, 173 bp, Homo sapiens
  misc_feature: GYAE6OF01B7LC1.21.78.H01.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttccctcgtctctactgagcgggctggcaaggcgcatagn

SEQ ID NO: 261753 - DNA, 136 bp, Homo sapiens
  misc_feature: GYAE6OF01DR20V.21.78.H01.1.454.CMB.1.raw
  modified_base (130)..(136): a, c, t, g, unknown or other
  misc_feature (130)..(136): n is a, c, g, or t
tcagtcgtcgctcgcacgaccggtgctcgatttagtgtgagtagtttgggttgggcacagcggccctgggctgcctggtcaaggactacttccctcgtctctactgagcgggctggccaaggcgcatagnnnnnnn

SEQ ID NO: 261754 - DNA, 129 bp, Homo sapiens
  misc_feature: GYAE6OF01CRN8Q.21.78.H01.1.454.CMB.1.raw
tcagtcgtcgctcgcacgaccggtgctcgatttagtgtgagtagtttgggtttgggcacagcggccctgggctgcctggtcaaggactacttccctcgtctctactgagcgggctggcaaggcgcatag

SEQ ID NO: 261755 - DNA, 129 bp, Homo sapiens; identical to SEQ ID NO: 261754
  misc_feature: GYAE6OF01A8QUG.21.78.H01.1.454.CMB.1.raw

SEQ ID NO: 261756 - DNA, 560 bp, Homo sapiens
  misc_feature: GYAE6OF01DLJ15.21.78.H01.1.454.CMB.1.raw
  modified_base (482)..(482): a, c, t, g, unknown or other
  misc_feature (482)..(482): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagctggggtccgccaggctccgaggggaacgggcccggagtggatctcacttattatagtggtcggtaccacatactacacagactcgtagaacgggccgattcacatctcagaagacaattccaaggaacacattgtatctacaaactgaataacctgagagcgaagacacggcatgtattactgtgtgggntatttacgtcgacccggtggggcccggggtaaccctcggtccaccgtcctacccccaccctcccaccgacggaccccg

SEQ ID NO: 261757 - DNA, 131 bp, Homo sapiens
  misc_feature: GYAE6OF01BHUAI.21.78.H01.1.454.CMB.1.raw
  modified_base (130)..(131): a, c, t, g, unknown or other
  misc_feature (130)..(131): n is a, c, g, or t
tcagtcgtcgctcgcacgaccggtgctcgatttagtgtgagtagtttgggtttgggcacagcggccctgggctgcttggtcaaggactacttccctcgtctctactgagcgggctggcaaggcgcatagnn

SEQ ID NO: 261758 - DNA, 173 bp, Homo sapiens; identical to SEQ ID NO: 261752
  misc_feature: GYAE6OF01EBGC9.21.78.H01.1.454.CMB.1.raw
  modified_base (173)..(173): a, c, t, g, unknown or other
  misc_feature (173)..(173): n is a, c, g, or t

SEQ ID NO: 261759 - DNA, 135 bp, Homo sapiens
  misc_feature: GYAE6OF01AH8YJ.21.78.H01.1.454.CMB.1.raw
  modified_base (130)..(135): a, c, t, g, unknown or other
  misc_feature (130)..(135): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnn

SEQ ID NO: 261760 - DNA, 138 bp, Homo sapiens
  misc_feature: GYAE6OF01ECOFL.21.78.H01.1.454.CMB.1.raw
  modified_base (130)..(138): a, c, t, g, unknown or other
  misc_feature (130)..(138): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnnnn

SEQ ID NO: 261761 - DNA, 135 bp, Homo sapiens; identical to SEQ ID NO: 261759
  misc_feature: GYAE6OF01AMT1S.21.78.H01.1.454.CMB.1.raw
  modified_base (130)..(135): a, c, t, g, unknown or other
  misc_feature (130)..(135): n is a, c, g, or t

SEQ ID NO: 261762 - DNA, 182 bp, Homo sapiens
  misc_feature: GYAE6OF01CSQYI.21.78.H01.1.454.CMB.1.raw
  modified_base (173)..(182): a, c, t, g, unknown or other
  misc_feature (173)..(182): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttcccgagcgacgactgagcgggctggcaaggcgcatagnnnnnnnnnn

SEQ ID NO: 261763 - DNA, 129 bp, Homo sapiens; identical to SEQ ID NO: 261754
  misc_feature: GYAE6OF01CR3C4.21.78.H01.1.454.CMB.1.raw

SEQ ID NO: 261764 - DNA, 130 bp, Homo sapiens; identical to SEQ ID NO: 261715
  misc_feature: GYAE6OF01D022O.21.78.H01.1.454.CMB.1.raw
  modified_base (130)..(130): a, c, t, g, unknown or other
  misc_feature (130)..(130): n is a, c, g, or t

SEQ ID NO: 261765 - DNA, 130 bp, Homo sapiens; identical to SEQ ID NO: 261715
  misc_feature: GYAE6OF01CDW3H.21.78.H01.1.454.CMB.1.raw
  modified_base (130)..(130): a, c, t, g, unknown or other
  misc_feature (130)..(130): n is a, c, g, or t

SEQ ID NO: 261766 - DNA, 184 bp, Homo sapiens
  misc_feature: GYAE6OF01AFLQG.21.78.H01.1.454.CMB.1.raw
  modified_base (173)..(184): a, c, t, g, unknown or other
  misc_feature (173)..(184): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttcccgagcgacgactgagcgggctggcaaggcgcatagnnnnnnnnnnnn

SEQ ID NO: 261767 - DNA, 129 bp, Homo sapiens; identical to SEQ ID NO: 261754
  misc_feature: GYAE6OF01A8CC8.21.78.H01.1.454.CMB.1.raw

SEQ ID NO: 261768 - DNA, 132 bp, Homo sapiens; identical to SEQ ID NO: 261738
  misc_feature: GYAE6OF01EXTM8.21.78.H01.1.454.CMB.1.raw
  modified_base (130)..(132): a, c, t, g, unknown or other
  misc_feature (130)..(132): n is a, c, g, or t

SEQ ID NO: 261769 - DNA, 162 bp, Homo sapiens
  misc_feature: GYAE6OF01B5AB0.21.78.H01.1.454.CMB.1.raw
  modified_base (129)..(162): a, c, t, g, unknown or other
  misc_feature (129)..(162): n is a, c, g, or t
tcagtcgtcgctcgcacgaccggtgctcgatttagtgtgagtagtttgggtttgggcacagcggccctgggctgcctggtcaaggctacttccctcgtctctactgagcgggctggcaaggcgcatagnnnnnnnnnnnnnnnnnnnnnnnnnnnnnnnnnn

SEQ ID NO: 261770 - DNA, 552 bp, Homo sapiens
  misc_feature: GYAE6OF01BVXV3.21.78.H01.1.454.CMB.1.raw
  modified_base (535)..(535): a, c, t, g, unknown or other
  misc_feature (535)..(535): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaacgggcctgggagtggatctcactttattatagtggtggtaccacatactacacagactcgtgaacggccgattcaccatctacagaagacaattccaagaacactattgtatctacaaatgaataacctgagagccgaggacacggccagtgtatacgtgtggtgggctagtttcgtcgtacccgtggggcccgggacctggtcctaccgtcctaccccnccctcccaccgaaccgg

SEQ ID NO: 261771 - DNA, 132 bp, Homo sapiens; identical to SEQ ID NO: 261738
  misc_feature: GYAE6OF01A0O9J.21.78.H01.1.454.CMB.1.raw
  modified_base (130)..(132): a, c, t, g, unknown or other
  misc_feature (130)..(132): n is a, c, g, or t

SEQ ID NO: 261772 - DNA, 712 bp, Homo sapiens
  misc_feature: GYAE6OF01A8UO2.21.78.H01.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccnccaggcctcgaggggacggctgggagtggactctactactttatttataggtcggtacgtaccacatactacacacgactcggtaggaacgggtcctattccacctattctacaaggaaacgaactaacgttacccgaaggtaaaccactaatttacgtaacttaccttaacaaattacgaaacttaaccctaggaacgtacgacccggtaaggaccgaccgggtacctaagttacgttaacgtttaacgttgggttagggttacggggtacctttaacgtttttaacccggtcccgggtaacccccggggttacgggggggtacccccggggtaaacccttcgggtaccccgtacccccggttacccctaccccccccgaccccgttccccgaaacccggtaaccccgggg

SEQ ID NO: 261773 - DNA, 139 bp, Homo sapiens
  misc_feature: GYAE6OF01EIZOT.21.78.H01.1.454.CMB.1.raw
  modified_base (130)..(139): a, c, t, g, unknown or other
  misc_feature (130)..(139): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnnnnn

SEQ ID NO: 261774 - DNA, 666 bp, Homo sapiens
  misc_feature: GYAE6OF01AYQU9.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgcaggctcgaggggaacgggcctgggagtggactctctactttatttagtaggtggtcgtaccatatactacacagactcgtagacgggctattcaccatactacagaacgactaactacgaaggaaccactattcgtaattaccttacaaagttacgaacttaaccgtggaacgtacggacccggaacggaccgtaaccgggacctaagtttacgtaagttacgttgggtagggttacggggtacttaacgttttaacggttcccggtacccccgggttacgggggggacccccggttaacccgttcgggtacccgtaccccgttccctacccccccgacccgttacccgacccggtaaccccggg

SEQ ID NO: 261775 - DNA, 131 bp, Homo sapiens; identical to SEQ ID NO: 261723
  misc_feature: GYAE6OF01CDJR5.21.78.H01.1.454.CMB.1.raw
  modified_base (130)..(131): a, c, t, g, unknown or other
  misc_feature (130)..(131): n is a, c, g, or t

SEQ ID NO: 261776 - DNA, 722 bp, Homo sapiens
  misc_feature: GYAE6OF01AQS0A.21.78.H01.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagtgtgagtagtttgggtttgggggggtaggagggaggcccagcactgggattccgaggtgtttccattcggtgatcagcactgaacacagaggactcaccatggagttttggctgagtctgggttttaccttgttgtcttatttcaaaaggtgtccagtgtgagtgcagttggtgagactggaggagntgatccagccgtgggggtccctggagtactctctgtcgcagtctcgtgggttcgtcaggtcggacgtactacagtgaggtctcggggtccaccgtaggcgtacccgagggggaaccgggccttggggaaggttggaacttcgtcctaactttaagtttagtaggttcgggtcggtaacccataactactaccgaactacggacctttacccggtaggaacgggggtaccctactttacccgaactacgtttcgtacgaacgtaaacgtacaactttaccgacggaaactacgtaagttataacgtacctttaaacgaagtaacgaaacttaccggttaagaacggtacggaaccggtaacgtaaccggacccgtaccgtaagtacgttacgttaactggtacgggtagggtacctagtttaacgccgtaaccccggtcggggacccgggtaccctacggtcctacccggtccctaccccgacccgtacgacccgtaccgg

SEQ ID NO: 261777 - DNA, 135 bp, Homo sapiens; identical to SEQ ID NO: 261759
  misc_feature: GYAE6OF01BR4MM.21.78.H01.1.454.CMB.1.raw
  modified_base (130)..(135): a, c, t, g, unknown or other
  misc_feature (130)..(135): n is a, c, g, or t

SEQ ID NO: 261778 - DNA, 137 bp, Homo sapiens
  misc_feature: GYAE6OF01EJM1E.21.78.H01.1.454.CMB.1.raw
  modified_base (130)..(137): a, c, t, g, unknown or other
  misc_feature (130)..(137): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnnn

SEQ ID NO: 261779 - DNA, 130 bp, Homo sapiens; identical to SEQ ID NO: 261715
  misc_feature: GYAE6OF01D9GQX.21.78.H01.1.454.CMB.1.raw
  modified_base (130)..(130): a, c, t, g, unknown or other
  misc_feature (130)..(130): n is a, c, g, or t

SEQ ID NO: 261780 - DNA, 714 bp, Homo sapiens
  misc_feature: GYAE6OF01BCE1B.21.78.H01.1.454.CMB.1.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgcttatttacaaaaggtgtccagtgtgaggtgcgtagttggtggagactgggaggaggcttgatccagccgtgggggtccctgacgtctctcctgtgcagtctgtggttcgtcaggtgcgactacatgacgcgtcgggtaccgccgaggccgtccgaaggggacggccgtgggacgtggacttcgtactaacgtttatttataggtcggtcggtaaccaacgtactaacgtacgacacggtaccgttccggtaaggaaccggggtacctaacgttacccaacccttaagtccgttaacgaaacggtaaacgaaccgtaacgttacccgaaacggtaaacctaaccttaagtttacgttaacttacctttaacaaaagttacgtaaacttaaccggtagaacggtacggtaccggaacggaccgaccggtacctagttacgtaacgttacgtggtacggtaggtacttaagttacgtcggacccggtcgggggaccccgtaaccgtcgtacgtaccccgttccctaccccgaccctccgaacccgtaccgg

SEQ ID NO: 261781 - DNA, 132 bp, Homo sapiens
  misc_feature: GYAE6OF01AV3LB.21.78.H01.1.454.CMB.1.raw
  modified_base (129)..(132): a, c, t, g, unknown or other
  misc_feature (129)..(132): n is a, c, g, or t
tcagtcgtcgctcgcacgaccggtgctcgatttagtgtgagtagtttgggtttgggcacagcggccctgggctgcctggtcaaggactacttccctgtctctactgagcgggctggcaaggcgcatagnnnn

SEQ ID NO: 261782 - DNA, 135 bp, Homo sapiens; identical to SEQ ID NO: 261759
  misc_feature: GYAE6OF01BC2Q7.21.78.H01.1.454.CMB.1.raw
  modified_base (130)..(135): a, c, t, g, unknown or other
  misc_feature (130)..(135): n is a, c, g, or t

SEQ ID NO: 261783 - DNA, 130 bp, Homo sapiens; identical to SEQ ID NO: 261715
  misc_feature: GYAE6OF01B65FI.21.78.H01.1.454.CMB.1.raw
  modified_base (130)..(130): a, c, t, g, unknown or other
  misc_feature (130)..(130): n is a, c, g, or t

SEQ ID NO: 261784 - DNA, 759 bp, Homo sapiens
  misc_feature: GYAE6OF01COL2N.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtaggttttggctgagtcgttgggtttttccttgttgcttatttacaaaaggtcgtccagtgtgaggtgcgtaggttggtggagtacgtgggagggtaggtccgtttagacgttcccgaggtcccgggttcggggggtcccctggacggtaccttccttccgttggtcgcgtcggttcgttcggttgggttaccgtcgagggtcggaccgtacttaacgatggacgtccggtcgggtaccgccgagggtccctacgggacggggtaacgggtccggtagggtaggttcggtaacttccttacgttaaccttttagttaggtacggttcggtacggtaccaacgtactacgacgtacacgtacgtacgtaggaccggtactacttcaacgtatcgtaacgagaactacgtaactacgaacgtaactactagttagttatacgttaactaaagtactaataaccgtagaacggtacgaccgaacggacgaccgtacgattagtacttacggtgtcgggttagccttacgttaccggtccggttaacccgggcggggttacccggtacccggtggttacccctcccggttacccctccccccgtaaccgaccccgtacggtacccccgg

SEQ ID NO: 261785 - DNA, 672 bp, Homo sapiens
  misc_feature: GYAE6OF01BQZGB.21.78.H01.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagacctctcctgtgcagtctcgtgggttcgtcaggtggcgtactacatgagcgtcgggtcccgcgaggcctaccggaggggacggcgtggagtggatctctatttattatagtggtacgtacactatacacacacgactcggtaggaacggcctacttcaccattctacgaacgaactaactaacttaccgaaggtaaacacgtaatttcgtattaccttanaaatcgaaacttaaccgtaggaacgacggaccgaacggaaccacgggtacctaagtgttaactttacgtgggtcggtacggggtacttaaccgttttaccgaccggttaccccggggtccgggggtaaccccggggtaccttccgggtaccccgtacccggttaccccctacccccaccccgttaccccgacccggtaaaccccggg

SEQ ID NO: 261786 - DNA, 182 bp, Homo sapiens
  misc_feature: GYAE6OF01CLOCS.21.78.H01.1.454.CMB.1.raw
  modified_base (175)..(182): a, c, t, g, unknown or other
  misc_feature (175)..(182): n is a, c, g, or t
tcagtcgtcgctcgcacgaccggtgctcgatttagtgtgagtagtttgggtttggggggaagaggaagactgacggtccccccaggagttcaggtgctgggcacagcggccctgggctgcctggtcaaggactacttccctcgtctctactgagcgggctggcaaggcgcatagnnnnnnnn

SEQ ID NO: 261787 - DNA, 968 bp, Homo sapiens
  misc_feature: GYAE6OF01BL4IQ.21.78.H01.1.454.CMB.1.raw
  modified_base (951)..(951): a, c, t, g, unknown or other
  misc_feature (951)..(951): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacacgagactcgaccatggtagttttggctgagcttgggttttccttgttacgcttatttacaaaaggttcgtccagtgtgaggtgctagttggtggagacgtgggaggtaggcttagactccgacggccggtcgggggtaccctgacgtaccttcctccgtcggtcgacgtcgttccttccggttcggggttccgtaccgtagggtcggtaccgtaaccttaacgtaacgttcggtaacggtccgggttaccggggtccccgtaacccggtacgggtacccggttaccccgggtaaacggggggaaccggggttccccggtttaggggggtaaaccgggtttacggggtaaaccctttacccggtttaaccggtttaaacccgtttttaaaggtttttaacgggtaaccggggtttacggggtttaaccggttaaaccccgttaaaccggtttaaacttaacccggttaaacccgaaccggttaaccgggtaaccccggttaccgggtaacggggtaaaccccgggtacgtaacctttaccccggaaaccttcgttaacccgttacggtaaaacgaacgtaacccgttaacgttaaacccgaaacgggtaaacctacccgttaagtttaaccgttaacgttacctttaaactaaacgttaacgtaaaccgttaacccggtagaaaccgggtacgaacccgggagtaacccgaccgggtacctaagttacgttagtcgtaacggtcggtgggtaacttacggtttacccgtaccggtacccgggtacgggccccggtaaccgtcgtcccgtacccgtcccctaccccgtaccccnccgtaacccgtacccgg

SEQ ID NO: 261788 - DNA, 133 bp, Homo sapiens
  misc_feature: GYAE6OF01DREDG.21.78.H01.1.454.CMB.1.raw
  modified_base (130)..(133): a, c, t, g, unknown or other
  misc_feature (130)..(133): n is a, c, g, or t
tcagtcgtcgctcgcacgaccggtgctcgatttagtgtgagtagtttgggtttgggcacagcggccctgggctgcatggtcaaggactacttccctcgtctctactgagcgggctggcaaggcgcatagnnnn

SEQ ID NO: 261789 - DNA, 895 bp, Homo sapiens
  misc_feature: GYAE6OF01AUY9H.21.78.H01.1.454.CMB.1.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggagggaggcttagatccaggtcccggtcggggggggttccctggagaccttcctcctggtgccgagttccgttcgtggggttccgtcgtaggtcggcgtactactataggacgtcggtcgggtcccgacgacgggccgtccggaaagggggaacgggtcccggttagggacggtagggtacttcgtacttaacgttttaagttttaagtacggttcgggttaacgggtaaccctaaccgtaacttaacctaacctaaccgtacggaacccggttacccgggtaagggaaaccggggacccgttaaactttacccgaacccctaacgtttaccgttaaccgaaacggtaaaaccgtaaccgtaaacccgttacccgaaaacgggtaaacctaaccgttaagtttaacggtttacttaactttaaacgtaaaaacgttaacgtaaaccgtaaaccgtaacggtaaagggaacccggtacccgggaacggaacccggtaaccggtaccgtaacgtttaacgtttacgtttaaccgttgggttacggtacggggttacttaacggtttaccgttcccggtacccggggttacggggggtaccccggggtaacccggttccgggtacccgttaaccccggtaccccgtacccccggtaccccctacccggtaacccggaaccccggg

SEQ ID NO: 261790 - DNA, 751 bp, Homo sapiens
  misc_feature: GYAE6OF01BD3WE.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgctatttacaaaaggtgtccagtgtgaggtgcggttggtggagacgtggaggaggcttgatccagccgtgggggtcctgagactctcctgtgcagtctcgtggttcgtcaggtggacgactacatgagcgtcgggtccgccgagccgtccggagggaacgggccgtggagtggatctctactttatttagtagtggtcgtaccaacactactacacacgtacgtccggtaggaacgggtcctagtaccacctacgtactacgaagaacgtaacctaacgtacccgaaaggaaaccctaacttagtttacgtaactttaccttaacgtaaagtacgtaaactaacccgtaggaacgaccggaccggaagaaccgaccggtaacctagtacgttaatttacggtggttacgggttacgggtacctttaacggttttaacccgttacccgggtaacccccggggttacggggggtaacccccgggggtaaccccgtttacgggtaccccgttacccccgggttaccccccttacccccccgtaccccccggtaaaccccaccccggggtaaaccccgggtaccccccgg

SEQ ID NO: 261791 - DNA, 131 bp, Homo sapiens
  misc_feature: GYAE6OF01DOG44.21.78.H01.1.454.CMB.1.raw
  modified_base (96)..(96): a, c, t, g, unknown or other
  misc_feature (96)..(96): n is a, c, g, or t
  modified_base (129)..(131): a, c, t, g, unknown or other
  misc_feature (129)..(131): n is a, c, g, or t
tcagtcgtcgctcgcacgaccggtgctcgatttagtgtgagtagtttgggtttgggcacagcggccctgggctgcctggtcaaggactacttcccngtctctactgagcgggctggcaaggcgcatagnnn

SEQ ID NO: 261792 - DNA, 878 bp, Homo sapiens
  misc_feature: GYAE6OF01BWK3H.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtaggttttggctgagctgggttttccttgttgctatttacaaaaggtgtccagtgtgaggtgcaggttggtggagacgtgggagggaggcttggatccgacggccgttcggggggtccctggacgtactctcgtggtgctagtcgtcgttaggggttccgtctagggtcggcggtaacttacaagtcggaacggtccggttcggggtcccgccgaagggtccgtacccggtaaggggaaccggtccgtagggtacggtcggtacttacgtacgtaccgttttaagtttacgtaggttacggttaacggtacctaacgaacgttaacctaccgtaaccgtacggtaacccgttcggtaagggaaaccgggtccgtaacggttacccaacccgttaagtccgtaaccgtaagtaaaccggtaacgaactttacccggaaacggtaaaccttaacaagttttaacggtaacttacgttaacaaacggtacgttaaacgtaaccgttaggaaccgacggtaacccggtaagggaaccctacgggtacctaagttacggttaccttaacggtgggttagggtaccgggttaaccttaacggtttttacccggtaccggtacccccgggggtttacgggggggtaaccccccgttaacccgggtttccggttacccccgtaacccgggttccccccttaaaaccccccgtccccggtaaaccccgggtaaaccgggtaaaccccccgggg

SEQ ID NO: 261793 - DNA, 957 bp, Homo sapiens
  misc_feature: GYAE6OF01AJA3B.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggtttttccttgttgctatttacaaaaggtgtccagtgtgaggtgcagttggtggagactggaggaggtcttgactccaggccgtgggggtccctgagctctcctgtgcagtctcgtgggttcgtcaggtcggcgactacatggacgcgtacggggtcccgaccgacgggcctaccggaagggggaacgggtcccgtagggtaacggtcgggtaacttccgtacctaacgttttaattttaagttaggttacgggttccggttaaccctaacgtaacttaaccctaaccgaacgtaacgtaaccgttcccggtaacggggaaaccggggtccccgtaaacgttttcccaaacccgtacgttaccccgttaccgaaagggtaaaaccgtaaccttaaaaccgtttaccccggaaaacggggtaaaccctaaaccgtaaacgtttttacggtaaacctttacccgtttaaacgtaaaaacgtttacgtaaaaaccgtttaaccccggtttagggaaaccgggtaaccgggtaaccccgggtaaacggggtaaaccccggaacccgggtaacccctaaagtttaacggtttaacgtttaaccggttagggttacggggttacgggggtaacctttaccggttttttaaacccggttcccgggttaaccccccccggggttacggggggggtaccccccgggggttaaccccggtttccgggttacccccgtaaccccccggttttcccccaaccccccccccgttacccccgttaacccccgtaaaccccgggttaaaccccccggggg

SEQ ID NO: 261794 - DNA, 160 bp, Homo sapiens
  misc_feature: GYAE6OF01B4V74.21.78.H01.1.454.CMB.1.raw
  modified_base (129)..(160): a, c, t, g, unknown or other
  misc_feature (129)..(160): n is a, c, g, or t
tcagtcgtcgctcgcacgaccggtgctcgatttagtgtgagtagtttgggtttgggcacagcggccctgggctgcctggtcaaggactacttccctgtctctactgagcgggctggcaaggcgcatagnnnnnnnnnnnnnnnnnnnnnnnnnnnnnnnn

SEQ ID NO: 261795 - DNA, 797 bp, Homo sapiens
  misc_feature: GYAE6OF01D22RI.21.78.H01.1.454.CMB.1.raw
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagtcgtcgctcgcacgaccggtgctcgatttagtgtgagtagtttggggtttgggggggagaggagcccagcacgtgggattccgaggtgtttccattcggtgatcagcactagaacacagacggactcaccagtggtagttttggctgagtcgttggttttccttgttgtcttattacgaaaggtcgtacgagttggtagtaggtcgcgtaggttggtaggagtacggtagggaggtagtcgttagactccggtacggtccgggttcggggtcctaggacgtccgttccgtcgtggtcgacgtcgttccgttcggttcgggtcgtacgnggtccgacgtacgtacgngtggacgtcggtccggccgacggacggtccgtacgggacgggtaaccgggtcgtagggtacgtacggtacttacgttaccgtttaacgtttaagttttacgggtacggttacgggttaaccggtaacctaacgtaaacgttaacccgtacgaaaccggtaccggtaccggttacgggtaacgggtacccggtacttaccgttacccgaacgtactaccgtaacgaagtaaccggtaacctacgtaaccgaactaacgttaacttatacgttactaagttaaccaacgtaacgtaataccgagaacgacggacgaccgacgtacgtactagttactagttacgtaggtaggtacgttactacgtttaccggccggtaccgggtacgggaccccgtacgtccgtacccgtacccgtacccctaccccgaccgtcccgacccgtacccgg

SEQ ID NO: 261796 - DNA, 800 bp, Homo sapiens
  misc_feature: GYAE6OF01ANY6M.21.78.H01.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagtgtgagtagtttggggtttggggggggagaggagcccagcactgggattccgaggtgttttccattcggtgatcagcactgaacacagaggactcaccatggtagttttggctgagtcgtttgggtttttccttgttgcttatttacgaaaaggtcgtccagtgtgaggtgctaggttggtggaggacgtgggagggnggtcttgactccgacggtccgggttcgggggggttcccctaggacgtaccttccgtcccgtggtcgaccgtacgttccgttcggttcggggtttccgtagtaggtcggaccggtacttaccagtcggacgtccggttcgggtaccccgccggacggtccgtaccgaacgggggtaacggtccggtaggtaggttacggtacttcgtactaactttttagttacgttaggtacggttacggtaacctaacgtactaaccgtacctaacgtacgggtacccgttcgggtaacgggaacccgggtacccgttaaccgttaccgaaccctagttacccgtaaccgaacggaaacggtacctaaccgttaccgaaaacggtaacctaactttacgtttaagttacttacgttaacaaagtaagtaactacggtagaacggacgtaccgagacccacggctagtattatacgtggttggcggtacgttagtaccgttaccggtcccgggtacgggtcccggtacccgttacgtccctacccgtccccacccctccgaccccgacgtaccccgg

SEQ ID NO: 261797 - DNA, 681 bp, Homo sapiens
  misc_feature: GYAE6OF01A7MX2.21.78.H01.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatgggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatcgagcgtgggtccnccgaggccgtccgaggggacgggccgtgggacggtgggattcgtctacgtttatttagtacggtggtcggtaaccacgtactactacacagaccgtccgtgaacggggctagttaccaccgtatctacgaagaacgacaacttccaaggaaactacgtaacttagtacttaccttaacaaatgaaacttaaccgtgaacgacggtaccgaaggaccgacgggtacccaagttacgttaattacgtggttacggtggggtacttaacgttttaccgttccgggtaccccggttagggggggtacccccgggtaacccgtcgggtacccgtaccccggtccctaccccccgtacccgtccccgaacccggtaaccccggg

SEQ ID NO: 261798 - DNA, 973 bp, Homo sapiens
  misc_feature: GYAE6OF01DBSI3.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcgtttcgggttttccttgttcgtcttaattacgaaaaggtcgtaccgtaggtgtggaggtcgtcgtaggttgggtaggacggtacgtagggaggaggtccgttgactacccgacggtccgggttcgggggtaccgtgacgtaccttccgtcgttgtacgtacgtcggtccgttcggttcgggttcgtacgtcgggtacgaccgtaacgttacgaagtggacgtccggtccgggtccccggaccgtaccgggtccggttaaccgggaaggggacggtaccggtagggtaggtccggtacttaccgttaccttaagtttagtttaacggtaggttacgggtaaccgttacaactaacgtaacctaaccgtacgtaaaccggtaccggtacggtacggaccggtacctaactaccgtaaccacgttaacgtaaccgaaacggtaacgttaaccgtaaaccgtaaccggtaaacccgaaacttacgtttaaacgtttacggttaaacccttaacgtttaaacggtaaaactttacgttaaaacggtaaccgtaagggaaaccgtaaccggggtacccggaaacggtacccgttaaacccgttacgttaaggtttaaacccggtttacgttacgggttagggttaaccgggttccgggtttaaaccttttaaacccggtttcccgggttaaccccggggtaaaccccgggggtttacccgggggaccccgggtttaacccggaacccggtttcccccgtacccccgggttacccccccacccccggttaaaccccccgtaaccccgggtcccccgggttaaaaccccgg

SEQ ID NO: 261799 - DNA, 141 bp, Homo sapiens
  misc_feature: GYAE6OF01EPXZW.21.78.H01.1.454.CMB.1.raw
  modified_base (130)..(141): a, c, t, g, unknown or other
  misc_feature (130)..(141): n is a, c, g, or t
tcagtcgtcgctcgcacgaccggtgctcgatttagtgtgagtagtttgggttgggcacagcggccctgggctgcctggtcaaggactacttcccctgtctctactgagcgggctggccaaggcgcatagnnnnnnnnnnnn

SEQ ID NO: 261800 - DNA, 913 bp, Homo sapiens
  misc_feature: GYAE6OF01CYZGE.21.78.H01.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgtctatttcaaaaggtgtcagtgtgaggtgctaggttggtggagacgtgggaggaggcttgatccgaggccgtcgggggtcctgacgtactcgtcctgtcgacngttctcgttgggttccgtcaggtcggaccgtactacagtgacgtcgttcgggccgtccggacggccgtaccggaagggggtaacggggtcccgtaggggtacggttacgggtacttaccgtttaaccttaaattttacgttttaaagttacgggttacggggtttaccggtaaccctaaactaaacgtttaacccgtaaacccgtaaccgtaaaccggttaacccggttacccgggttaacggggaaaccgggggtaccccttaacgtttaacccgaaccccgttaaacgttccttaaacggaaacgtaaacgtaaacccttaaaccgtttacccggaaaaccggtaaacccgaattaaacgttttacgtaactttaccttaacgtaaaacgtaacgtaaaaccttaaaccgtagtaaacgtaccggaacccggaacggtaacccggaaccgtccttaagttacgtttaagtttaccggttagggttcgggttacggggtactttaacggttttaccggttacccgggtaacccccggggttacggggggtaacccccgggtaacccggttacgggtaccccgttaccccccggttaacccctaccccccgtaaacccctcccggtaaaccccggtaaccccggg

SEQ ID NO: 261801 - DNA, 838 bp, Homo sapiens
  misc_feature: GYAE6OF01CL6QV.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcacatggagtttggctgagcttgggttttccttgttgcttatttacaaaaggtgtccagtgtgaggtgcgagttggtggagacgtgggaggaggtcttagactccgacgtccggttcgggggtaccctgacgtacctcgttccgtggtgacgtacgtccgttcgttcgggttcgtcgtacggtggaccgtaactaacgagtagacggtcgtcgggtacccgaccgacggtaccgtaccggtaacggggaacgggtccgtagggacggttcggtacgttaccttacgttaacttttaagtttaacggttacgggttacggttaccggtaaccctaactaacgttaacccttaaccgaaccgtaacggtaccgtaccggtaagggtaaccgggacccgtacgtttaccaaccgtacttaccgtacggaaacggtaaacgtacctaacgttaacccggaaacgtaactaacgtatttagtaacttaccgttaaagaaacgttacgtaaactaacccggtggaaacggtaaccgccgggtaaaccgggaaccgtaccgggtaaccttaagttacggttaacgttccgttaggggttacggtacgggactttaacgtttaccggtcccgggtaacccggggtccgggggtaacccccggtacgttcgtcccccgtacgtacccccgtacccctaccccggacgaacccgtacccggg

SEQ ID NO: 261802 - DNA, 822 bp, Homo sapiens
  misc_feature: GYAE6OF01A4WGI.21.78.H01.1.454.CMB.1.raw
tcagtcgtcgctcgcacgaccggtgctcgatttagtgtgagtagtttgggtttgggggggagaggagcccagcactgggattccggaggtgtttccattcggtgatcagcactgaacacagaggactcaccagtggtagttttgctgagtcgttggttttccttgttgtcttatttacgaaaaggttcgtccgtagtgtgtaggtcgtcgaggtttgggtggtacgacgtagggagggagtcgttagacgtccgtacggtccggtcgggggtcctgacgtccttccgtctgtcgtcgtacgtcgttcggtcgggttccgtacgtggtacggtacgtaacctacgtagtacggtacggtaccggtcgggtacccgacgtacggaccgtaccggggaaacgggtacggtcggtggtacggtaggtaccgtacgtttaccgtaacgtttagttacgtagggtaccgtacggtacctagtacctaacgttaccgaacgtacgtaccgttacggtacggtaaccgggtcctaacgtcctaacgtaccgtaacgtacgagtaaacgttacctaaccgttacgaacgtaactacgttaagttactacttacgttaactaagtacctaaacgtacgttacggaaccgtacgaccggaacgtaccgaacggttaccttaagttcgttacgtaccggttgttacgggtcgttacggttacctttaaccggttccccgggtaacggttaccccggggtcccgggttaaacccgtcggttaacccgtccccggttaccctaaccccgtaccccgaaccgtacccggtaccccgg

SEQ ID NO: 261803 - DNA, 139 bp, Homo sapiens
  misc_feature: GYAE6OF01BOQCU.21.78.H01.1.454.CMB.1.raw
  modified_base (129)..(139): a, c, t, g, unknown or other
  misc_feature (129)..(139): n is a, c, g, or t
tcagtcgtcgctcgcacgaccggtgctcgatttagtgtgagtagtttgggttgggcacagcggccctgggctgcctggtcaaggactacttccctcgtctctactgagcgggctggcaaggcgcatagnnnnnnnnnnn

SEQ ID NO: 261804 - DNA, 888 bp, Homo sapiens
  misc_feature: GYAE6OF01AYXA8.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcagttgggtggagacgtgggaggaggcttgatccgaggccggttcggggggtccctggacgtaccgtcctcctaggtgcgtaggtcttccgttggggttaccgtcgtaaggtcgggaccgtaacttacgagttacggaggtccgttcggggtccccgaccgagggtcctaccggaagggggtaacggggcccgttgggaggtgggacttccgtctaacttttaagtttagtaggttcgggtacggtacccaactaattacaaccgacgaacgtacgttccggtaggaacggggtcccttaaattaccacccgtaattaccgtacgaaagtaaccggaacttaacgttacccggaaagggtaaacctaaccgttaaagttttccggttaacttaaccgtttaacaaaaagttaaccggttaaaacctaaccggttaggtaaacggccggtaaccgggtaaaccgggaacccgtaaccgggtcccttaaggttacgtttaacttaccgggtttggtacggggtacgggttaccttagttttaacccgggttaccggtacccccggggttacggggggtaaaccccccggggtaacccggttcccgggttaaccccggtaccccccggttaccccccgtttaccccccccgaacccccggttaaccccgtaccccggggtaaaacccccgggg

SEQ ID NO: 261805 - DNA, 165 bp, Homo sapiens
  misc_feature: GYAE6OF01CBHV6.21.78.H01.1.454.CMB.1.raw
  modified_base (133)..(165): a, c, t, g, unknown or other
  misc_feature (133)..(165): n is a, c, g, or t
tcagtcgtcgctcgcacgaccggtgctcgatttagtgtgagtagtttggggtttgggcacagcggccctgggctgcctggtcaaggctacttccctcgtctctactggagcgggctggccaaggccgcatagnnnnnnnnnnnnnnnnnnnnnnnnnnnnnnnnn

SEQ ID NO: 261806 - DNA, 161 bp, Homo sapiens
  misc_feature: GYAE6OF01CBCDV.21.78.H01.1.454.CMB.1.raw
  modified_base (136)..(161): a, c, t, g, unknown or other
  misc_feature (136)..(161): n is a, c, g, or t
tcagtcgtcgctcgcacgaccggtgctcgatttagtgtgagtagtttggggtttgggcacagcggccctgggctgcctggtacaaggcttacttccctgtctctactgacggtcgggctggcaacggctcagtagnnnnnnnnnnnnnnnnnnnnnnnnnn

SEQ ID NO: 261807 - DNA, 171 bp, Homo sapiens
  misc_feature: GYAE6OF01EQ8QC.21.78.H01.1.454.CMB.1.raw
  modified_base (74)..(74): a, c, t, g, unknown or other
  misc_feature (74)..(74): n is a, c, g, or t
  modified_base (129)..(129): a, c, t, g, unknown or other
  misc_feature (129)..(129): n is a, c, g, or t
  modified_base (131)..(171): a, c, t, g, unknown or other
  misc_feature (131)..(171): n is a, c, g, or t
tcagtcgtcgctcgcacgaccggtgctcgatttagtgtgagtagtttgggtttgggcacagcggccctgggctncctggtcaaggactacttccctcgtctctactgaggcgggctggcaaggcgctangnnnnnnnnnnnnnnnnnnnnnnnnnnnnnnnnnnnnnnnnn

SEQ ID NO: 261808 - DNA, 126 bp, Homo sapiens
  misc_feature: GYAE6OF02H0QW2.21.78.H01.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagtgtgagtagtttggttggcacagcggcctgggctgcctggtcaaggactacttccctcgtctctactgagcgggctggcaaggcgcatagn

SEQ ID NO: 261809 - DNA, 130 bp, Homo sapiens
  misc_feature: GYAE6OF02HVWXP.21.78.H01.1.454.CMB.1.raw
  modified_base (129)..(130): a, c, t, g, unknown or other
  misc_feature (129)..(130): n is a, c, g, or t
tcagtcgtcgctcgcacgaccggtgctcgatttagtgtgagtagttgggtttgggcacagcggccctgggctgcctggtcaaggactacttccctcgtctctactgagcgggctggcaaggcgcatagnn

SEQ ID NO: 261810 - DNA, 169 bp, Homo sapiens
  misc_feature: GYAE6OF02HBVDS.21.78.H01.1.454.CMB.1.raw
  modified_base (169)..(169): a, c, t, g, unknown or other
  misc_feature (169)..(169): n is a, c, g, or t
tcagtcgtcgctcgcacgaccggtgctcgatttagtgtgagtagtttgggttgggaagaggaagactgacggtccccaggagttcaggtgctgggcacagcggccctgggctgcctggtcaaggactacttccctcgtctctactgagcgggctggcaaggcgcatagn

SEQ ID NO: 261811 - DNA, 129 bp, Homo sapiens
  misc_feature: GYAE6OF02GQ57I.21.78.H01.1.454.CMB.1.raw
tcagtcgtcgctcgcacgaccggtgctcgatttagtgtgagtagtttgggtttgggcacagcggccctgggctgcatggtcaaggactacttccctcgtctctactgagcgggctggcaaggcgcatag

SEQ ID NO: 261812 - DNA, 137 bp, Homo sapiens; identical to SEQ ID NO: 261778
  misc_feature: GYAE6OF02IXI3V.21.78.H01.1.454.CMB.1.raw
  modified_base (130)..(137): a, c, t, g, unknown or other
  misc_feature (130)..(137): n is a, c, g, or t

SEQ ID NO: 261813 - DNA, 187 bp, Homo sapiens
  misc_feature: GYAE6OF02G6TC0.21.78.H01.1.454.CMB.1.raw
  modified_base (173)..(187): a, c, t, g, unknown or other
  misc_feature (173)..(187): n is a, c, g, or t
tcagtcgtcgctcgcacgaccggtgctcgatttagtgtgagtagtttgggtttggggaagaggaagactgacggtccccaggagttcaggtgctgggcacagtcggccctgggctgcctggtcaaggactacttccctcgtctctactgagcgggctggcaaggcgcattagnnnnnnnnnnnnnnn

SEQ ID NO: 261814 - DNA, 130 bp, Homo sapiens; identical to SEQ ID NO: 261715
  misc_feature: GYAE6OF02IJLDC.21.78.H01.1.454.CMB.1.raw
  modified_base (130)..(130): a, c, t, g, unknown or other
  misc_feature (130)..(130): n is a, c, g, or t

SEQ ID NO: 261815 - DNA, 194 bp, Homo sapiens
  misc_feature: GYAE6OF02I66VL.21.78.H01.1.454.CMB.1.raw
  modified_base (173)..(194): a, c, t, g, unknown or other
  misc_feature (173)..(194): n is a, c, g, or t
tcagtcgtcgctcgcacgaccggtgctcgatttagtgtgagtagtttgggtttggggaagaggaagacgtgacggtccccaggagttcaggtgctgggcacagcggccctgggctgcctggtcaaggactacttcccgagcgacgactgagcgggctggcaaaggcgcatagnnnnnnnnnnnnnnnnnnnnnn

SEQ ID NO: 261816 - DNA, 129 bp, Homo sapiens
  misc_feature: GYAE6OF02GQKNX.21.78.H01.1.454.CMB.1.raw
tcagtcgtcgctcgcacgaccggtgctcgatttagtgtgagtagtttgggtttgggcacagcggccctgggctgccctgggtcaaggactattccctcgtctctactgacgggctggcaaggcgcatag

SEQ ID NO: 261817 - DNA, 130 bp, Homo sapiens; identical to SEQ ID NO: 261715
  misc_feature: GYAE6OF02H41DK.21.78.H01.1.454.CMB.1.raw
  modified_base (130)..(130): a, c, t, g, unknown or other
  misc_feature (130)..(130): n is a, c, g, or t

SEQ ID NO: 261818 - DNA, 128 bp, Homo sapiens
  misc_feature: GYAE6OF02FXANE.21.78.H01.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagtgtgagtagtttgggttggcacagcggccctgggctgcctggtcaaggactacttccctcgtctctactgagcgggctggcaaggcgcatagn

SEQ ID NO: 261819 - DNA, 131 bp, Homo sapiens
  misc_feature: GYAE6OF02G8RZC.21.78.H01.1.454.CMB.1.raw
  modified_base (129)..(131): a, c, t, g, unknown or other
  misc_feature (129)..(131): n is a, c, g, or t
tcagtcgtcgctcgcacgaccggtgctcgatttagtgtgagtagtttgggttgggcacagcggccctgggctgcctggtcaaggactacttccctcgtctctactgagcgggctggcaaggcgcatagnnn

SEQ ID NO: 261820 - DNA, 130 bp, Homo sapiens; identical to SEQ ID NO: 261715
  misc_feature: GYAE6OF02GNTXV.21.78.H01.1.454.CMB.1.raw
  modified_base (130)..(130): a, c, t, g, unknown or other
  misc_feature (130)..(130): n is a, c, g, or t

SEQ ID NO: 261821 - DNA, 130 bp, Homo sapiens; identical to SEQ ID NO: 261715
  misc_feature: GYAE6OF02FU6HP.21.78.H01.1.454.CMB.1.raw
  modified_base (130)..(130): a, c, t, g, unknown or other
  misc_feature (130)..(130): n is a, c, g, or t

SEQ ID NO: 261822 - DNA, 148 bp, Homo sapiens
  misc_feature: GYAE6OF02F2UF2.21.78.H01.1.454.CMB.1.raw
  modified_base (130)..(148): a, c, t, g, unknown or other
  misc_feature (130)..(148): n is a, c, g, or t
tcagtcgtcgctcgcacgaccggtgctcgatttagtgtgagtagtttggttgggcacagcggccctgggctgcctggtcaaggactacttccctcgtctctactgagcgggactggcaaggccgcatagnnnnnnnnnnnnnnnnnnn

SEQ ID NO: 261823 - DNA, 174 bp, Homo sapiens; identical to SEQ ID NO: 261747
  misc_feature: GYAE6OF02IJEP6.21.78.H01.1.454.CMB.1.raw
  modified_base (173)..(174): a, c, t, g, unknown or other
  misc_feature (173)..(174): n is a, c, g, or t

SEQ ID NO: 261824 - DNA, 130 bp, Homo sapiens; identical to SEQ ID NO: 261715
  misc_feature: GYAE6OF02HB6Y4.21.78.H01.1.454.CMB.1.raw
  modified_base (130)..(130): a, c, t, g, unknown or other
  misc_feature (130)..(130): n is a, c, g, or t

SEQ ID NO: 261825 - DNA, 592 bp, Homo sapiens
  misc_feature: GYAE6OF02JYQD6.21.78.H01.1.454.CMB.1.raw
  modified_base (129)..(134): a, c, t, g, unknown or other
  misc_feature (129)..(134): n is a, c, g, or t
  modified_base (146)..(147): a, c, t, g, unknown or other
  misc_feature (146)..(147): n is a, c, g, or t
  modified_base (152)..(152): a, c, t, g, unknown or other
  misc_feature (152)..(152): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (167)..(167): a, c, t, g, unknown or other
  misc_feature (167)..(167): n is a, c, g, or t
  modified_base (174)..(175): a, c, t, g, unknown or other
  misc_feature (174)..(175): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
tcagtcgtcgctcgcacgaccggtgctcgatttagtgtgagtagtttgggttgggcgacagcggccctggctgcctggtcaaggactacttcccgagcgacgactgagcggctggcaagccgcatacgnnnnnngctcagtgctcnngcatncgngcgngctgcgcntcgctgnngtcagcgngngcngcgacgcacgngtgcgtcgtgngacncgttntaagtaccggtatagtagcccggtgcaaagaccncgaccganacgcgaaagtttactcgagtacgtttcccgcgtccgtttcgggcgtcgtaaaacccgacgtacgacgacgtacgtacgacgacgtacgtacgtacgtacgtcgtacgtacgtacgtcgacgacgtacgtacgtacgtacgtacgtacgtcgtacgtacgtacgtacgacgtacgacgacgtacgtacgtacgacgacgacgtacgacgtacgtacgtacgtacgtacgtacgtacgtacgtacgtacgtacgtacgtaccgtacgtacgtacgtaccgtacgtacgtacgtacgtacgtacgtacgtacgtacgtacgtaccgtacgtacg

SEQ ID NO: 261826 - DNA, 175 bp, Homo sapiens
  misc_feature: GYAE6OF02GZP85.21.78.H01.1.454.CMB.1.raw
  modified_base (173)..(175): a, c, t, g, unknown or other
  misc_feature (173)..(175): n is a, c, g, or t
tcagtcgtcgctcgcacgaccggtgctcgatttagtgtgagtagtttgggtttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 261827 - DNA, 174 bp, Homo sapiens; identical to SEQ ID NO: 261747
  misc_feature: GYAE6OF02F40W2.21.78.H01.1.454.CMB.1.raw
  modified_base (173)..(174): a, c, t, g, unknown or other
  misc_feature (173)..(174): n is a, c, g, or t

SEQ ID NO: 261828 - DNA, 130 bp, Homo sapiens; identical to SEQ ID NO: 261715
  misc_feature: GYAE6OF02I43B5.21.78.H01.1.454.CMB.1.raw
  modified_base (130)..(130): a, c, t, g, unknown or other
  misc_feature (130)..(130): n is a, c, g, or t

SEQ ID NO: 261829 - DNA, 129 bp, Homo sapiens; identical to SEQ ID NO: 261754
  misc_feature: GYAE6OF02IOUYB.21.78.H01.1.454.CMB.1.raw

SEQ ID NO: 261830 - DNA, 132 bp, Homo sapiens; identical to SEQ ID NO: 261738
  misc_feature: GYAE6OF02F14A0.21.78.H01.1.454.CMB.1.raw
  modified_base (130)..(132): a, c, t, g, unknown or other
  misc_feature (130)..(132): n is a, c, g, or t

SEQ ID NO: 261831 - DNA, 140 bp, Homo sapiens
  misc_feature: GYAE6OF02FU970.21.78.H01.1.454.CMB.1.raw
  modified_base (130)..(140): a, c, t, g, unknown or other
  misc_feature (130)..(140): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnnnnnn

SEQ ID NO: 261832 - DNA, 131 bp, Homo sapiens
  misc_feature: GYAE6OF02GDSTR.21.78.H01.1.454.CMB.1.raw
  modified_base (129)..(131): a, c, t, g, unknown or other
  misc_feature (129)..(131): n is a, c, g, or t
tcagtcgtcgctcgcacgaccggtgctcgatttagtgtgagtagtttgggtttgggcacagcggccctgggctgcctggtcaaggactacttccctcgttctactgagcgggctggcaaggcgcatagnnn

SEQ ID NO: 261833 - DNA, 181 bp, Homo sapiens
  misc_feature: GYAE6OF02HS2N5.21.78.H01.1.454.CMB.1.raw
  modified_base (132)..(181): a, c, t, g, unknown or other
  misc_feature (132)..(181): n is a, c, g, or t
tcagtcgtcgctcgcacgaccggtgctcgatttagtgtgagtagtttgggtttgggcacagcggccctgggctgcctgggtcaaggactacttcccctgtctctactgagcgggctggcaaggcgcatagcnnnnnnnnnnnnnnnnnnnnnnnnnnnnnnnnnnnnnnnnnnnnnnnnnn

SEQ ID NO: 261834 - DNA, 560 bp, Homo sapiens
  misc_feature: GYAE6OF02G6T58.21.78.H01.1.454.CMB.1.raw
  modified_base (354)..(354): a, c, t, g, unknown or other
  misc_feature (354)..(354): n is a, c, g, or t
  modified_base (481)..(481): a, c, t, g, unknown or other
  misc_feature (481)..(481): n is a, c, g, or t
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtgtggtaccanatactacacagactcgtgaagggccattcaccatctacagaacgacaattccaagaacacattgtatcttacaaatgaaataacctgagagaccgaagacacggccagtgtattacgtgtggtgggntactttacgtggaccccgtgggggacccgggtaaccctggtcccaccggtcctcccccacccgtcccgaccgaaccggg

SEQ ID NO: 261835 - DNA, 129 bp, Homo sapiens; identical to SEQ ID NO: 261754
  misc_feature: GYAE6OF02IWI21.21.78.H01.1.454.CMB.1.raw

SEQ ID NO: 261836 - DNA, 129 bp, Homo sapiens; identical to SEQ ID NO: 261754
  misc_feature: GYAE6OF02GVNI1.21.78.H01.1.454.CMB.1.raw

SEQ ID NO: 261837 - DNA, 539 bp, Homo sapiens
  misc_feature: GYAE6OF02GRYV2.21.78.H01.1.454.CMB.1.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccnccaggctccagggaagggcctggagtggatctcacttatttatagtggtggtaccanatactacacagactccgtgaagggccattcaccatctcagaagacaattccaggaacacattgtatcttcaaatgaataacctgagagccgaggacacggccatgtattactgtgtgggctagtttacgtgacccgtggggcccgggtaacctggtcaccgtctccccgacctccacgtaaccgg

SEQ ID NO: 261838 - DNA, 132 bp, Homo sapiens
  misc_feature: GYAE6OF02I3QP5.21.78.H01.1.454.CMB.1.raw
  modified_base (129)..(132): a, c, t, g, unknown or other
  misc_feature (129)..(132): n is a, c, g, or t
tcagtcgtcgctcgcacgaccggtgctcgatttagtgtgagtagtttggtttgggcacagcggccctgggctgcctggtcaaggactacttccctcgtctctactgagcgggctggcaaggcgcatagnnnn

SEQ ID NO: 261839 - DNA, 558 bp, Homo sapiens
  misc_feature: GYAE6OF02GAVPO.21.78.H01.1.454.CMB.1.raw
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtggtgtaccanatactacacagactcgtgaagggccattcaccatctcagaagacaatccaggaacacattgtatcttacaatnaataacctgagagccgagacacggccatgtattactgtgtgggctagtttacgttcgaccccgtgggggacccgggtaacccgtgggtccgacccggttcctacccccgaccctcccgacccgtaaccggg

SEQ ID NO: 261840 - DNA, 174 bp, Homo sapiens; identical to SEQ ID NO: 261747
  misc_feature: GYAE6OF02F83QK.21.78.H01.1.454.CMB.1.raw
  modified_base (173)..(174): a, c, t, g, unknown or other
  misc_feature (173)..(174): n is a, c, g, or t

SEQ ID NO: 261841 - DNA, 175 bp, Homo sapiens; identical to SEQ ID NO: 261826
  misc_feature: GYAE6OF02F9NI1.21.78.H01.1.454.CMB.1.raw
  modified_base (173)..(175): a, c, t, g, unknown or other
  misc_feature (173)..(175): n is a, c, g, or t

SEQ ID NO: 261842 - DNA, 137 bp, Homo sapiens; identical to SEQ ID NO: 261778
  misc_feature: GYAE6OF02JOADV.21.78.H01.1.454.CMB.1.raw
  modified_base (130)..(137): a, c, t, g, unknown or other
  misc_feature (130)..(137): n is a, c, g, or t

SEQ ID NO: 261843 - DNA, 173 bp, Homo sapiens; identical to SEQ ID NO: 261752
  misc_feature: GYAE6OF02GF0CM.21.78.H01.1.454.CMB.1.raw
  modified_base (173)..(173): a, c, t, g, unknown or other
  misc_feature (173)..(173): n is a, c, g, or t

SEQ ID NO: 261844 - DNA, 566 bp, Homo sapiens
  misc_feature: GYAE6OF02JGA0I.21.78.H01.1.454.CMB.1.raw
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttctcagtggcgactacatgagctgggtccgccaggctccgagggacggcctggagtggatctcacttattanagtggtgtaccanatactacacagactccgtagaacgggcccattccaccatcctcaagaagacaattccaaggaacactattagtatcttacaaatgaaatacctgacgacgcgagacacggccatcgtatactgtgtgggactagtttacgtcggacccgtgggggacccgggtaacccgtggtaccgacccggtccctaccccgaccctcccgacccgaaccggg

SEQ ID NO: 261845 - DNA, 176 bp, Homo sapiens
  misc_feature: GYAE6OF02IBPIB.21.78.H01.1.454.CMB.1.raw
  modified_base (174)..(176): a, c, t, g, unknown or other
  misc_feature (174)..(176): n is a, c, g, or t
tcagtcgtcgctcgcacgaccggtgctcgatttagtgtgagtagtttgggtttgggggaagaggaagactgacggtccccccaggagttcaggtgctgggcacagcggccctgggctgcctggtcaaggactacttcccgagcgacgactgagcgggctggcaaggcgcatagnnn

SEQ ID NO: 261846 - DNA, 568 bp, Homo sapiens
  misc_feature: GYAE6OF02G7B9C.21.78.H01.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccagggctccgagggaagggcctggagtggatctcacttattatagtggtggtaccacatactacacagactccgtgaagggccgattcaccatctcagagacaatccaggaacacatgtatcttcaatagaataacctgagagccgaggacgacgcatgtattacngtgtggggctagtttacgttcgaccccgttggggaccccggggtaacccgttcgggtaccgtacccggtccctacccccaccccgttcccgacctaacccggg

SEQ ID NO: 261847 - DNA, 129 bp, Homo sapiens; identical to SEQ ID NO: 261754
  misc_feature: GYAE6OF02H6RSM.21.78.H01.1.454.CMB.1.raw

SEQ ID NO: 261848 - DNA, 668 bp, Homo sapiens
  misc_feature: GYAE6OF02GYRCW.21.78.H01.1.454.CMB.1.raw
  modified_base (435)..(435): a, c, t, g, unknown or other
  misc_feature (435)..(435): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccccgagactctcctgtgcagtctcgtgggttcgtcagtggcgactacatgagcgtgggtccgccgaggctccgaggggacgggcctgggagtggatctcactttatttagtagtggtggtaccactataactacacagtactccgtaggaacgggccacttcaccatctacagaaacacaattccaaggaacctanaattgtaacttcttaacaaaattgaaacttaaccgtagaacgacgaccggaaggaaccgaccggaccaagttcgttaacgtttaaccttggtacgggtaggggaccttagttttaccgttccgggaacccccggttacgggggggaccccggggtaaaccccttcggggtaccctaccccggttaccccttaccccccgtacccctacccgtaaccccggacgggtacccccg

SEQ ID NO: 261849 - DNA, 178 bp, Homo sapiens
  misc_feature: GYAE6OF02I1ZJB.21.78.H01.1.454.CMB.1.raw
  modified_base (174)..(178): a, c, t, g, unknown or other
  misc_feature (174)..(178): n is a, c, g, or t
tcagtcgtcgctcgcacgaccggtgctcgatttagtgtgagtagtttgggtttggggggaagaggaagactgacggtcccccaggagttcaggtgctgggcacagcggccctgggatgcctggtcaaggactacttccctcgtctctactgagcgggctggcaaggcgcatagnnnnn

SEQ ID NO: 261850 - DNA, 129 bp, Homo sapiens; identical to SEQ ID NO: 261754
  misc_feature: GYAE6OF02HSP09.21.78.H01.1.454.CMB.1.raw

SEQ ID NO: 261851 - DNA, 551 bp, Homo sapiens
  misc_feature: GYAE6OF02IW0FT.21.78.H01.1.454.CMB.1.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttctcagtggcgactacatgagctgggtccgccaggctccgagggaagggcctggagtggatctcacttattatagtggtggtaccacatacctacacagactccgtagaagggccgattcaccatctcagaagacaattcccaggaaacactattgtaatcttacaaatgaaataacctgagagccgaaggacacggcagtgtattatgtgtgggctagtttcgtgcccgtggggcccgggaacctggtccaccggtcctaccccaccttcccgaccgtaccgg

SEQ ID NO: 261852 - DNA, 555 bp, Homo sapiens
  misc_feature: GYAE6OF02GBU2K.21.78.H01.1.454.CMB.1.raw
  modified_base (358)..(358): a, c, t, g, unknown or other
  misc_feature (358)..(358): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggcctccgaggggaagggccctgggagtggatctcacttattatagtggtggtaccanatacacacagactccgtgaagggccgattcgaccatcacagaagacaattccaggaacacattgtatcttanaaatnaaataacctgagacgacgagacacggccatcgtatactgtgtgggatatttacgttcgacccgtgggggacccgggaccgtcggtccaccggtcctcccccaccctcccaccgtacccgg

SEQ ID NO: 261853 - DNA, 596 bp, Homo sapiens
  misc_feature: GYAE6OF02H2PNM.21.78.H01.1.454.CMB.1.raw
  modified_base (426)..(426): a, c, t, g, unknown or other
  misc_feature (426)..(426): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagcgtgggtcccgccgaggctccgaggggaacgggcctggagtggatctcactttatttatagtggtagtaccacatactacacagactccgtgaaggccgattcaccatctcagaagactaatccaaggaacacattntatcttacaaatgaataactgaacgagccgaaggacaccgggctagtgtaattactggttgtgggactacgtttttacgtccgtaccccggttcgggggacccggggtaaccccgtgggtaccctacccgtcccgttacccccgacccttccccgaacccgtaacccggg

SEQ ID NO: 261854 - DNA, 750 bp, Homo sapiens
  misc_feature: GYAE6OF02JJK2U.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacagtgagcgtgggtccgccaggctccgagggacgggcctggagtggatctctacttagtttatagtggtggtaccactatactacacagactccgtagaacgggtccattccacatctacaagaacgacaacttccgaaggaacaacgtattacgtacttcgttaactaaattacgaaactttaaaccgtgaacggtaaccgtaccgggaaaggaacccgtaacccgggacccttaagtttaccgggttaaagttttaaccgttacgggttacgggttacggggggttacccttaaaggtttttaaccccggttttccgggaaccccccgggtttacggggggggggtacccccccgggggtaaaaccccgtttcggggttaaccccccgttaacccccggggtttacccccttaccccccccccggaacccgttacccccccggtaaacccgggtaaacccccggggg

SEQ ID NO: 261855 - DNA, 131 bp, Homo sapiens; identical to SEQ ID NO: 261723
  misc_feature: GYAE6OF02HZ9N4.21.78.H01.1.454.CMB.1.raw
  modified_base (130)..(131): a, c, t, g, unknown or other
  misc_feature (130)..(131): n is a, c, g, or t

SEQ ID NO: 261856 - DNA, 924 bp, Homo sapiens
  misc_feature: GYAE6OF02HXDFJ.21.78.H01.1.454.CMB.1.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactcctcctgtgctagtctcgtgggttcgtcgagtggcgactacatgagcgtcgggtccgccaggctccggaaggggaacgggccgtggagtggatctactactttattataggttggtacggtaaccacgtacttaacctacacgtaagacctccggtaggaacggggtcctaacgtttcccaacctacgttacctacgaaaggtaaacgtaacctaaacgtttccccgaaaaggggtaaaccctaacgtaagttttacggtaaactttacccgtttaaaacgaaaaacgttcgggtaaaaacccttttaaaacccggttgggaaaaaccgggtaaccggtaacccccgggggtaaaacgggtaaaccccggtaaacccgggggttaaccctaaacggttttaccgggtttaaaaccgttttacccgggttaggggtttaccgggggttaaccgggggggttacccttttaaaaccgggtttttttaccccgggttaccccgggggtaaccccccccgggggtttagggggggggggtaaacccccccgggggtttaaaacccccgtttccggggggttaacccccttaacccccccgggggtttaccccccttaacccccccccggtaaacccccccggtttacccccgggaaaaccccccggttaaaccccgggggg

SEQ ID NO: 261857 - DNA, 573 bp, Homo sapiens
  misc_feature: GYAE6OF02HQU84.21.78.H01.1.454.CMB.1.raw
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagtcgtcgctcgcacgaccggtgctcgatttagtgtgagtagtttgggtttgggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtccgcaggcctcaggggagggcctggagtggatctcactttatttatagtggtaggtaccacaatactacacagactccgtagaagggccattcaccatctcagaanacaatccagaacacattgtatctanaaatanaataactgagacgacgaggacacgcatagtattactggtgtgggctatttacgtggacccccggttggggacccggggtaacccttgggtacccacccggttccctaccccccgaccttaccccgaccgtaaacccggg

SEQ ID NO: 261858 - DNA, 807 bp, Homo sapiens
  misc_feature: GYAE6OF02HMPP7.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggtttttccttgttgctatttcaaaaggtgtccagtgtgaggtgcagtggtggagactggagggagcgttgatccagccgtggggggtccctgacgactctcctgtgcagtctgtgggttcgtcaggtcggcgaactacatgagtcgtggggtcccgccgaggcctccgaaggggaacggccgtggaggtggactctctaactttatttatagtgggtgtaccatatactaacacgaagtaccgtccggtaggaaacgggccgaattccacctaagtcctacgaagaaagaacctaaattcccgaaaggaaccaaaccgtaattttacgtaacttacgtttaactaaaaacgttaggtaaaaacttaaacccgtagaaaacgggacccggtaacccgggaaaaccgggaacccgaacccggggacccctaaaggtttaacgggtttaaactttaacggtttacggggtcgggttacggggggtacctttaaccggttttttaacccgttacccggggtaaacccccggggttcccggggggggtaaacccccggggggttaaaccccggttccggggttacccctaaccccgggttcccccgtttaaccccccccggaacccccctttaccccgaacccccgggtaaaaccccgggg

SEQ ID NO: 261859 - DNA, 142 bp, Homo sapiens
  misc_feature: GYAE6OF02I7OXK.21.78.H01.1.454.CMB.1.raw
  modified_base (110)..(110): a, c, t, g, unknown or other
  misc_feature (110)..(110): n is a, c, g, or t
  modified_base (131)..(142): a, c, t, g, unknown or other
  misc_feature (131)..(142): n is a, c, g, or t
tcagtcgtcgctcgcacgaccggtgctcgatttagtgtgagtagtttgggtttgggcgacagcggccctgggctgcctggtcaaggactacttccctcgtctctactgancgggctggcaaggcgcatagnnnnnnnnnnnn

SEQ ID NO: 261860 - DNA, 134 bp, Homo sapiens
  misc_feature: GYAE6OF02HREDO.21.78.H01.1.454.CMB.1.raw
  modified_base (130)..(134): a, c, t, g, unknown or other
  misc_feature (130)..(134): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnn

SEQ ID NO: 261861 - DNA, 174 bp, Homo sapiens; identical to SEQ ID NO: 261747
  misc_feature: GYAE6OF02FG8KS.21.78.H01.1.454.CMB.1.raw
  modified_base (173)..(174): a, c, t, g, unknown or other
  misc_feature (173)..(174): n is a, c, g, or t

SEQ ID NO: 261862 - DNA, 140 bp, Homo sapiens
  misc_feature: GYAE6OF02H49L9.21.78.H01.1.454.CMB.1.raw
  modified_base (131)..(140): a, c, t, g, unknown or other
  misc_feature (131)..(140): n is a, c, g, or t
tcagtcgtcgctcgcacgaccggtgctcgatttagtgtgagtagtttgggtttgggcacagcggccctgggctgcctgggtcaaggactacttccctcgtctctactgagcgggctggcaaggcgcatagnnnnnnnnnn

SEQ ID NO: 261863 - DNA, 565 bp, Homo sapiens
  misc_feature: GYAE6OF02FJY6L.21.78.H01.1.454.CMB.1.raw
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccnccaggctccgaggggagggcctgggagtggactctctacttatttatagtggtggtaccatatactacacagactccgtgaacggggccattccaccatctacagaagacaacttacccaggaaaccacacttagtactcttacaaatgaaataacctganagcgaggacacgcatnaattcgtgtgtgggctagtttacgtcgaccccgtgggggcccgggtaaccgtggtccaccggtcctcccccgaccctcccaccgaaccgg

SEQ ID NO: 261864 - DNA, 608 bp, Homo sapiens
  misc_feature: GYAE6OF02HL8D9.21.78.H01.1.454.CMB.1.raw
  modified_base (503)..(503): a, c, t, g, unknown or other
  misc_feature (503)..(503): n is a, c, g, or t
  modified_base (569)..(569): a, c, t, g, unknown or other
  misc_feature (569)..(569): n is a, c, g, or t
tcagtcgtcgctcgcacgaccggtgctcgatttagtgtgagtagtttgggtttgggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtcccgccaggctccgaggggaacgggcctgggagtgggatctacacttatttatagtgggtggtaccacatactacacagactcgagaacgggccattccactatctacagaagactaattaccgaaggtaacacgatttgtacttccttaacaaatagtaaactaaacctggagacgccggaaggaccgacgccattagtattacnggtagggtgggcttacgtttacgtcggtaccccgggtggggccccggggtaaccctgggttacccnccggttccctcccccgtaccctcccgaaccggtacccgg

SEQ ID NO: 261865 - DNA, 134 bp, Homo sapiens; identical to SEQ ID NO: 261860
  misc_feature: GYAE6OF02GQY77.21.78.H01.1.454.CMB.1.raw
  modified_base (130)..(134): a, c, t, g, unknown or other
  misc_feature (130)..(134): n is a, c, g, or t

SEQ ID NO: 261866 - DNA, 137 bp, Homo sapiens; identical to SEQ ID NO: 261778
  misc_feature: GYAE6OF02GNJU8.21.78.H01.1.454.CMB.1.raw
  modified_base (130)..(137): a, c, t, g, unknown or other
  misc_feature (130)..(137): n is a, c, g, or t

SEQ ID NO: 261867 - DNA, 133 bp, Homo sapiens
  misc_feature: GYAE6OF02JIW2S.21.78.H01.1.454.CMB.1.raw
  modified_base (131)..(133): a, c, t, g, unknown or other
  misc_feature (131)..(133): n is a, c, g, or t
tcagtcgtcgctcgcacgaccggtgctcgatttagtgtgagtagtttgggtttgggcgacagcggccctgggctgcctggtcaaggactacttccctcgtctctactgagcgggctggcaaggcgcatagnnn

SEQ ID NO: 261868 - DNA, 133 bp, Homo sapiens
  misc_feature: GYAE6OF02F0YPY.21.78.H01.1.454.CMB.1.raw
  modified_base (130)..(133): a, c, t, g, unknown or other
  misc_feature (130)..(133): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnn

SEQ ID NO: 261869 - DNA, 136 bp, Homo sapiens
  misc_feature: GYAE6OF02F3Z2J.21.78.H01.1.454.CMB.1.raw
  modified_base (130)..(136): a, c, t, g, unknown or other
  misc_feature (130)..(136): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcgcatagnnnnnnn

SEQ ID NO: 261870 - DNA, 136 bp, Homo sapiens
  misc_feature: GYAE6OF02ITO5H.21.78.H01.1.454.CMB.1.raw
  modified_base (129)..(136): a, c, t, g, unknown or other
  misc_feature (129)..(136): n is a, c, g, or t
tcagtcgtcgctcgcacgaccggtgctcgatttagtgtgagtagtttgggtttgggcacagcggccctgggctgcctggtcaaggctacttccctcgtctctactgagcgggctggcaaggcgcatagnnnnnnnn

SEQ ID NO: 261871 - DNA, 135 bp, Homo sapiens; identical to SEQ ID NO: 261759
  misc_feature: GYAE6OF02I8RCS.21.78.H01.1.454.CMB.1.raw
  modified_base (130)..(135): a, c, t, g, unknown or other
  misc_feature (130)..(135): n is a, c, g, or t

SEQ ID NO: 261872 - DNA, 132 bp, Homo sapiens; identical to SEQ ID NO: 261738
  misc_feature: GYAE6OF02F1GDQ.21.78.H01.1.454.CMB.1.raw
  modified_base (130)..(132): a, c, t, g, unknown or other
  misc_feature (130)..(132): n is a, c, g, or t

SEQ ID NO: 261873 - DNA, 133 bp, Homo sapiens; identical to SEQ ID NO: 261868
  misc_feature: GYAE6OF02GU9LU.21.78.H01.1.454.CMB.1.raw
  modified_base (130)..(133): a, c, t, g, unknown or other
  misc_feature (130)..(133): n is a, c, g, or t

SEQ ID NO: 261874 - DNA, 667 bp, Homo sapiens
  misc_feature: GYAE6OF02GTFLE.21.78.H01.1.454.CMB.1.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtggggggtccctgagactctcctgtgcagtctcgtgggttcgtcgagtggcgactacatgagcgtcgggtccgccgaggcctccgaggggaacgggccgtggaggtggatctctactttatttatagttggtgtaccacatactacacagtactccgtagaacgggccgtattccaccatctacgaagaacgaactaacttccgaagaacactattgtattccttacaaattagaaacttaaaccgtgaacgacgtaccggaacggaaccgaccggactaacgttagttaacctttacgtggttacgggtacggggtacttaagttttaccgttcggacccccgggttggggggaacccccggggtaacccgtcggttacccggaccccggttccccgtaacccccctaccccgtacccaccccggtaaccccggg

SEQ ID NO: 261875 - DNA, 742 bp, Homo sapiens
  misc_feature: GYAE6OF02FQPXE.21.78.H01.1.454.CMB.1.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagaccgtaggaggagtcgtgacgtccgacgccggtcggggtcctgacgactcgtctgcgcgtacgtctcggttcggttacgtcgtaggtcggcgtaacctactgtaggacgtcggtcgggtccccgaccgtacggccgtaccgggaacggggaaccggtccgtgggtaggtagtacgtcgtaccttaacgttttagttagttaggttacggtacgtaaccctagtaactaaccgtaacacgtacgtaccgtacggtaacggtaaccgggtccgttacgtaccgtacctactctaacgtaacgaacgtaactaacgtaccgtaacgtaacgaatacttacgttactacttaacgaattaacgtaactaacgtacgaagtacggacgacgaccgaccgactagttacgttactacgtaggtggtacgggtacttacgttaccgttacccggtaccgggtacccgggggtaacccggtaccggtaccggttaccgtaccccgtcccgtacccccgtacccgtacccgtacccggtacccg

SEQ ID NO: 261876 - DNA, 672 bp, Homo sapiens
  misc_feature: GYAE6OF02GDWX5.21.78.H01.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgctatttcaaaaggtgtccagtgtgaggtgcagttggtggagactgggaggaggcttgatccagccgtcggggggtccctgacgactctccgtgtgcagtctcgtcgggttcgtcgaggtggcgactacngtagagtcgtcgggtcccgccgacggtcctacggaagggacgggtccgtgggaggtggactctacgtaactttatttagtagttcggtacggttaccaactactactaacacaacgtaccgtccggtacggaacgggaccgtattacccacctatcctacgaagaaagaacctaacttaccgaacgaaactaactagttagttacttacttaactaataataactaacctagaacggacgaccgaacggaccgacgtaccagttataattacgtgtggtcgggtattacgtttccgtacgtacccgggtccgggaccgggtacccgtcggtaccctaccgttccctaccccgtaccccgtacccgtacgaaccccgg

SEQ ID NO: 261877 - DNA, 137 bp, Homo sapiens
  misc_feature: GYAE6OF02JN7SW.21.78.H01.1.454.CMB.1.raw
  modified_base (132)..(137): a, c, t, g, unknown or other
  misc_feature (132)..(137): n is a, c, g, or t
tcagtcgtcgctcgcacgaccggtgctcgatttagtgtgagtagtttgggtttgggtcgacagcggccctgggctgcctggtcaaggactacttccctcgtctctactgagcgggctggcaaggcgcatagnnnnnn

SEQ ID NO: 261878 - DNA, 136 bp, Homo sapiens
  misc_feature: GYAE6OF02JGLX6.21.78.H01.1.454.CMB.1.raw
  modified_base (129)..(136): a, c, t, g, unknown or other
  misc_feature (129)..(136): n is a, c, g, or t
tcagtcgtcgctcgcacgaccggtgctcgatttagtgtgagtagtttgggtttgggcacagcggccctgggctgcctggtcaaggactacttccctgtctctactgagcgggctggcaaggcgcatagnnnnnnnn

SEQ ID NO: 261879 - DNA, 131 bp, Homo sapiens
  misc_feature: GYAE6OF02IKCWU.21.78.H01.1.454.CMB.1.raw
  modified_base (129)..(131): a, c, t, g, unknown or other
  misc_feature (129)..(131): n is a, c, g, or t
tcagtcgtcgctcgcacgaccggtgctcgatttagtgtgagtagtttgggtttgggcacagcggccctgggctgcctggtcaaggactacttccctgtctctactgagcgggctggcaaggcgcatagnnn

SEQ ID NO: 261880 - DNA, 809 bp, Homo sapiens
  misc_feature: GYAE6OF02IXETB.21.78.H01.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggtagttttggctgagcttgggttttccttgttgctatttcaaaaggtcgtccagtgtgaggtgtcgagttggtggagtaccggtaggagggaggtcttcggatcccgaggcccggttcgggggggtccctggtacggtaccttccgtcctggtcgctagttcctcgtgggttccgtcgagtggccgtactaacnctgagtcgtcggtacccgccgaggtccgccggaggggtaaccgggtccgtagggaaggtcggacgtccttaaccgtacgtttactttaagtggttcgggttacgtacctacctaacgtaactcctaacgacgtaccggtaccggtacgaaacgggggtccctaattacccggaacctactccgttaacgtaacggaaaccgtaaactaaccgttaccgaaaccggtaaccgtaactaaggtttacctacgtttaccttaaactaacgttaaacgtaaattaaccccgttagacggttaacgaaccgggtaaccggaaacgtacccgggtaccgtaacgttaacgttacgttaccggttggtacgggtcgggttacgttactttacggttaccgttacccggacgggggttaaccccggaccggtttacggtaccctaccgttcccgtaccccctacccgtacccgtacccgtaaccccggg

SEQ ID NO: 261881 - DNA, 1026 bp, Homo sapiens
  misc_feature: GYAE6OF02G7YY1.21.78.H01.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttggttgcttattttacgaaaaggtgtccagtgtgaggtgcagttgggtaggacgtacggngggaggtaggtcttagacgtaccgacggccggggttcgggggttcctaggacgtaccttccgttcgttcggaggtacctcgttcgttacggtttcggggttccgtaaggacggttcggaccgtaacctacgttaggaggtcgtcgggtaccgggccgtaccgacgggtacccgtacggaaacgggggttaacgggccgtagggtacgggtacgtaaccgtttccgtacctttaacggttttttaagtttaaaaggttcggggttacgggttaaaccggtaaccctaaacttaaacgtaacccttaaacgaacggtaccgtaacggtttccgggaaaagggtaaccccggggtatacccggttaacccaaaccgttacgtttaaccgaacgtaaaccggtaaacgtaaacccgttttaaaacgtaaaccggaaacccggtaaaacttaaccgtttaagtttaaacgttacgttttaaactaaaacgttaaacggttaacgttaaaaacctttaaccggaagggtaaacccgggaaccgtaaaccgggggaacccggtaaaccgtaccccggggtaaaccttaaggttttaacccgttaaagggttttacccgttaggggtacgggggttttacccgggtaacctttttaaccgggttttcccggtaaaccccggggttacccggggggttaacccgggggtaaacccccggtttaccggggttaaccccggttacccgttacccccggttaccccccggtaacccccgtaccccccgtttaacccccgaaaccggggttaacccccg

SEQ ID NO: 261882 - DNA, 755 bp, Homo sapiens
  misc_feature: GYAE6OF02GK8EH.21.78.H01.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggngagacgtggaggaggcttgatccgagtccgtgggggtcctgacgactctctgtncngtctgtgggttctcgagtcggctactacatgacgtcgtcgggtccgccaggccgtaccgaggggaacgggtccgttaggggacgttacgggtacttctaacgttacttttaagtttaatagggttcggtacggtaaccctagtaacgttaactaccgagtaacggtaccgttacggtaacgggtaacgggccttaaacggttaccaacgtactctaacgaaggtaaacgtaacaacgttaccaacggtaaactactaacttagtaaccttaacgtaaataacttaaacggtaaaccttaaccgtagaaccgggtacgacggtaacggaccgtaaccggaccttagttaagttaaccttacggtcgggttggtaccgggttcttaacgtttacccggtttccggtaccccgggttcggggtaacccggggttacccgtcggttacccgtaccccgtccccggtaccccctaccccgtaccgacccggtaacccggg

SEQ ID NO: 261883 - DNA, 142 bp, Homo sapiens
  misc_feature: GYAE6OF02HRBLS.21.78.H01.1.454.CMB.1.raw
  modified_base (124)..(124): a, c, t, g, unknown or other
  misc_feature (124)..(124): n is a, c, g, or t
  modified_base (130)..(142): a, c, t, g, unknown or other
  misc_feature (130)..(142): n is a, c, g, or t
tcagtcgtcgctcgcacgaccggtgctcgatttagtgtgagtagtttgggtttgggcacagcggccctgggctgcctggtcaaggactacttccctcgtctctactgagcgggctggcaaggcncatagnnnnnnnnnnnnn

SEQ ID NO: 261884 - DNA, 893 bp, Homo sapiens
  misc_feature: GYAE6OF02HTPK4.21.78.H01.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgttgggtttttccttgttgcttatttacaaaaggtcgtccagtgtgaggtgctaggtttgggtggacgacgtgggaagggaggtcgttgactccgacggccggttcggggggtcccctagacgtaccttccctcgtcgcgacgtcgttcgttcggttcgtcgtggtcgcggctaactcgagnggtccgtcggtaccgccgacggccggccggacgggacggggacggtggtaggtacggtactccgttacgttactttagtttaacgttaggtaggtacggttaacgtaacctaactaacgtacacgaaccgtacgtcggtacggacggacgtactacctaccgactactacgaacgaacgtaactacgttaaccgacggaactactaacgttcttaaacgtttacctaaacgtaaattaaacgtaaaccgttaaacccgtaggtaaaggaacccgggtaacccgggtaacccgggaacggtaaccccgggtaaacgttaacgtttaacggttttaacgtttaaccggtttagggttaccgggggttaccgggtttaacttttaccggtttttaccgggtttaacccccggggtaccccgggggttacccccgggggtaccccggggggttaaaccccccgttaccgggttaccccggttaaccccccgtttcccccccggtaacccccccgttaaccccccggttaaccccgacccccggggttaaaccccgtaaccccccggg

SEQ ID NO: 261885 - DNA, 138 bp, Homo sapiens; identical to SEQ ID NO: 261760
  misc_feature: GYAE6OF02JJ1TB.21.78.H01.1.454.CMB.1.raw
  modified_base (130)..(138): a, c, t, g, unknown or other
  misc_feature (130)..(138): n is a, c, g, or t

SEQ ID NO: 261886 - DNA, 584 bp, Homo sapiens
  misc_feature: GYAE6OF02F3RZE.21.78.H01.1.454.CMB.1.raw
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccaggccgtggggggtccctgacgactcctccgtgtcgcagtctcgttgggttcgtcgagttggcgactacatgagtcgtcgggtccgccaggctccgaggggaacggcctggaggtggactcgtactactttattagtagtggtcgtaccactatacacanagactcgagacggctatcacatcncaagacacatcgagaacnctatgtatctanaatnaaatacagagacgcgagacacgctagtntattacgtgtcgtggtcttagtttaccgtcgacccggttgggggacccggtaccgttcggtacccgtacccggttccccacccccgtacccgtaccgaacccgaacccggg

SEQ ID NO: 261887 - DNA, 137 bp, Homo sapiens; identical to SEQ ID NO: 261778
  misc_feature: GYAE6OF02JL93R.21.78.H01.1.454.CMB.1.raw
  modified_base (130)..(137): a, c, t, g, unknown or other
  misc_feature (130)..(137): n is a, c, g, or t

SEQ ID NO: 261888 - DNA, 733 bp, Homo sapiens
  misc_feature: GYAE6OF02GYPO2.21.78.H01.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggnggagacgtggaggaggcttgactccgagccgtgggggtcccngacgacctctctgtcgcngttctcgttgggttccgtgaggtcggcactaacagtgacgcgttgggcccgtccgcggcgtaccggacggggacgggccgtggaggtacgacgttctactacgttttaattacgttacggttggtacgttaaccacgtactaactacgactacgtacctcggaggaacggtctataccgacctactctacgaanaacgtactaacgttacgaacggtaacacgttacgtacgtacttacttaactaacgtacgtaaactaccgtagaaacggacgacggaacgaacccgacgtaccttaagtacgttaacgttggtaacggttcggtacggggtacttttacgtttacccgggttaacccggtaccccgggttacggggggtaccccggtaacccgttaccgggttacccctaccccggtttcccccgtaacccccctaaccccggttccccgaaacccgggtaccccggg

SEQ ID NO: 261889 - DNA, 618 bp, Homo sapiens
  misc_feature: GYAE6OF02GQCNH.21.78.H01.1.454.CMB.1.raw
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (471)..(471): a, c, t, g, unknown or other
  misc_feature (471)..(471): n is a, c, g, or t
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttacaaaaggtgtccagtgtgaggtgcagttgggtggagacgtgggagggaggcttgatccagccgtggggggtccctgagacctcctcctgtgcagtctcgttgggttcgtcaggtggacgactacatgagtcggtcgggtcccgccgacggccgtcccgaaggggaacgggtcctgggagtggatctctactttatttagtagtggtcgtacactataactacacagactcgtagacggcctatcaccntcanagaanactataccaagacatattgtatacttacaaatagaactactnagcgacgagaccacgacagtgttaactgtgtaggtcggtacttacgttaccgttcgggaccccggtcgggggtaacccggtacccgttcgggtacccctaccgggttcccctaccccccgtacccgtaccccgaacggtaccccggg

SEQ ID NO: 261890 - DNA, 781 bp, Homo sapiens
  misc_feature: GYAE6OF02FW6A8.21.78.H01.1.454.CMB.1.raw
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
tcagtcgtcgctcgcacgaccggtgctcgatttagtgtgagtagtttgggtttgggggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactggaggaggcttgatccagccgtgggggtccctgagactctctgtgcagtctcgtgggttcncngtgcgactacngtgagtcgtcgggcccgtccgaggcctcggaacggggaacgggtccgtagggtagtcgggtaactcgttactactttacgtttaagtggttggtacggtaccactaacgtactacaacgtacgtacgtcggtaggaaccggggtcctaacctttaccgacctacgttccgttacgaaaaggtaacgaaccttaaacgtttacccggaaagggtaaacttaacctaagtttaacgttacttaacctttaaacgtaaaagttacgtaaaaccgttaaccctagggtaaagtaacccggacccggaacgggtaaacccaccgggtaacccaagtttacgtttaaccgtttaaacgttggggtagggttacgggtaccgtttaaggtttacccgttaacgggacccccgggttacggggggtaccccggtaaacccgttcggtacccgtacccggttccccgtaccccccgtacccgttacccggaacccggtaacccgg

SEQ ID NO: 261891 - DNA, 789 bp, Homo sapiens
  misc_feature: GYAE6OF02HFZPK.21.78.H01.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagtttggctgagtcgttgggttttccttgttgcttatttacgaaaaggtgtccagtgtgaggtgctagttggnggagacgtgggaggaggctgatccgaggccggtcgggggtccctggacgtacctcctaccgtggtcgtacgagttccgtcggttgggttccgtacgaggtcggaccgtaactacgacgtggacgtccgtcgggtcccgccgacggtccgtaccggaacggggaacggtccgtagggtaacggtcggtacttccactttacgtttacttagtaggtcggtacggtaaccagtaactacaacacgacgtaccgttacgacggtaacgcgtaactacccaacctagttaccgagaaacgtaaacgtaaactaaacggttacccgaaacgtaaactaacgttacgtttaacgtacgtttacctaaagttaaacgacgttaaacgtaacccgtaggaacggacgaccgggtaaaccggacgtaaccggtacctaagttacgttacgttacggtgttacggtacgggtatttaaccgttaccgttcccgggtacccgggtaccgggggtaccccgggtaaccgtttccgggaaccccgttaccggttcccccgtaacccccacccgttaccccgaacccgtacccgg

SEQ ID NO: 261892 - DNA, 993 bp, Homo sapiens
  misc_feature: GYAE6OF02GV39V.21.78.H01.1.454.CMB.1.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgcttatttacaaaggtgtccagttgtggaggtgctaggttgggtacggagacgtgggaggaggtcttgactccgacggtcccggttcgggggggtccctaggacgtaccgttcctccgttgtcggaccgtacgttccgttcggttggggtttccgtccgtaggttcggaccgtaactacgtagtaggacggtccggttcggggttcccgccgtacgggtccgttacccggaagggggtaaaccggtccggtaggggtacgtaggggtactttccgtaccgtttaacgttttaacgttttaacggttacgggtttaggggttaaccggttaaacccgaacgttaaaccgtttaacccgtaaaccgtaacgtaccggttaaccgttccgggttaacgggaaccggggtacccgttaactttacccgaaccgttaccttacccgtaacgtaaaacgtaaaaccggtaacttaaacccgtttacccggaaacggtaaaacccgtacgttaaacgttttacggttaaacctttccgtttaaacctaaaagtttacggtaaaacctttaaaccgtacggtacgggaacccgtacccggggtaacgggaacccgtaccgggtaccgaaggttttactttaaaccgttaaccggtttagggttccgggggtaacccggttctttttaacggttacccggtttaaccccggggtacccggggttacccggggggttaacccccggggtaacccgtttcccgggttaaccccgtaccccccggtttccccccgtacccccggtaacccccttaccccgggaacccgtaacccccgggg

SEQ ID NO: 261893 - DNA, 318 bp, Homo sapiens
  misc_feature: GYAE6OF01C0DGJ.35.14.B03.1.454.CMB.1.raw
  modified_base (254)..(257): a, c, t, g, unknown or other
  misc_feature (254)..(257): n is a, c, g, or t
  modified_base (259)..(260): a, c, t, g, unknown or other
  misc_feature (259)..(260): n is a, c, g, or t
  modified_base (262)..(268): a, c, t, g, unknown or other
  misc_feature (262)..(268): n is a, c, g, or t
  modified_base (270)..(318): a, c, t, g, unknown or other
  misc_feature (270)..(318): n is a, c, g, or t
tcagtacagatcgtcacgaccggtgctcgatttagtgtgagtagttggggtttagggggggtgtggtggtcctccactcccgccttgacgaggctggactattactggtccagtcttatgatgggtagcaagtatgtggtcttggcgagggaccaagctgacgtcctaggtcagcccaagactgccccctggtcacctcctcgttcccgcccttctcacgatctgtactgacgcgggctggcaaggcgcaatgnnnnannannnnnnnannnnnnnnnnnnnnnnnnnnnnnnnnnnnnnnnnnnnnnnnnnnnnnnn

SEQ ID NO: 261894 - DNA, 295 bp, Homo sapiens
  misc_feature: GYAE6OF01EXNN3.35.14.B03.1.454.CMB.1.raw
  modified_base (244)..(244): a, c, t, g, unknown or other
  misc_feature (244)..(244): n is a, c, g, or t
  modified_base (250)..(295): a, c, t, g, unknown or other
  misc_feature (250)..(295): n is a, c, g, or t
tcagtacagatcgtcacgaccggtgctcgatttagtgtgagtagtttagggtttggggggtgtggtggtctccactcccgccttgacgaggctagactattactgtcagtcttatgatggtagcaaggtatgtggtcttcggcggagggaccaagctgaccgtcctaaggtcagcccaagactgccccctggtcactctgttcccgcctcctcacgatctgtactgagcgggctggacaaggcncatagnnnnnnnnnnnnnnnnnnnnnnnnnnnnnnnnnnnnnnnnnnnnnn

SEQ ID NO: 261895 - DNA, 518 bp, Homo sapiens
  misc_feature: GYAE6OF01EF39W.35.14.B03.1.454.CMB.1.raw
  modified_base (455)..(455): a, c, t, g, unknown or other
  misc_feature (455)..(455): n is a, c, g, or t
  modified_base (505)..(505): a, c, t, g, unknown or other
  misc_feature (505)..(505): n is a, c, g, or t
tcagtacagatcgtcacgaccggtgctcgatttagtgtgagtagttccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattcgaccaaagcaaatatacttattggtaccagcagaagtcaggccaggcccctgtattgatgatgtataaagacactgagagcccctgagggactcccgtgacgcgatttcgtctggcctccgagcctcgaagggaccaaacgagtctacgttcaccatcaggtggacgtccgaggacaaggaacgacgacggctagtatttattacgtgtacaatcagcagacaacaanaatacgtccgtgttggcgaggaccagctagaccgtcagcacgccaagccncgccccgtgtacc

SEQ ID NO: 261896 - DNA, 346 bp, Homo sapiens
  misc_feature: GYAE6OF02IWCVU.35.14.B03.1.454.CMB.1.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (334)..(346): a, c, t, g, unknown or other
  misc_feature (334)..(346): n is a, c, g, or t
tcagtacagatcgtcacgaccggtgctcgatttagtgtgagtagttagggttagggggtgtgggtggtcgtccgacctacccgccttacgacgaggcgtagactaattactgtcagtcgttatgatggtaaggccaagttatcgtggtcttcggcggagggaccaagcctagaccgtcctaggtcagcccaagactcgccccctcggtacgacctctggtttccccgcccctcgtccaccgtatcctcgtaacgtggacgccgggtcctgggcaaggccgcgagtaccggngcngctgcagctactcagtgcgngcngngcggcgngcgagcgnnnnnnnnnnnnn

SEQ ID NO: 261897 - DNA, 498 bp, Homo sapiens
  misc_feature: GYAE6OF01CT06V.16.46.E02.1.454.CMB.1.raw
  modified_base (467)..(467): a, c, t, g, unknown or other
  misc_feature (467)..(467): n is a, c, g, or t
tcagtgtactactccacgaccggtgctcgatttagactcatctacagggaaagggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagccccaggcacagccccaaatcatgatttatgaagtcagtaatcggcctcagggtccctgatcgcttctctgggtccaagtctggcaacacggcctccctgaccatctctgggctccaggctgaggacgaggctgattatactgcagcttatatacaggcaacaatacttttgcttcgactgggacaggtcacgtcagtcagccaagcaacccatgtcactctgtccccgcctcncgagtagtacactgacgcgggctggcaaggg

SEQ ID NO: 261898 - DNA, 532 bp, Homo sapiens
  misc_feature: GYAE6OF01B69Q0.16.46.E02.1.454.CMB.1.raw
tcagtgtactactccacgaccggtgctcgatttagactcatctacagggaaagggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcacgtcctaggtcagcccaaggcccaacccactcgtccactcctcgttccccgccctcctcggacgtacgtaccacgtgacgcgggctgggcaacggg

SEQ ID NO: 261899 - DNA, 528 bp, Homo sapiens
  misc_feature: GYAE6OF01CEOJ7.16.46.E02.1.454.CMB.1.raw
  modified_base (465)..(465): a, c, t, g, unknown or other
  misc_feature (465)..(465): n is a, c, g, or t
  modified_base (516)..(516): a, c, t, g, unknown or other
  misc_feature (516)..(516): n is a, c, g, or t
tcagtgtactactccacgaccggtgctcgatttagactcatctacagggaaaggggctgtgcctgggctctgctcctcctcaccctcctcactcaggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagccccaaatcatgatttatgaagtcagtaatcggccctcaggggtccctgatcgcttctctgggtccaagtctggcaacacggcctccctgaccatctctgggctccaggctgaggacgaggctgattattacttcagctttatatacaggcaataattacttttgtctttcggaactgggaccaaggtcaccgtctaggtcagcccaaggcccaacccntcgtacactctcgttccccaccctcctcacgtacgtaccactgacgcgggntcggcaaggccg

SEQ ID NO: 261900 - DNA, 531 bp, Homo sapiens
  misc_feature: GYAE6OF01ER4W8.16.46.E02.1.454.CMB.1.raw
tcagtgtactactccacgaccggtgctcgatttagactcatctacagggaaaggggctgtgcctggactctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaactaatacttttgtcttcggaactgggaccaaggtcacgtctaggtcagcccaaggcccaacccactgtcactcctcgttccccgccctcctcgacgtagtacaccttggacgcgggctgggcaacggg

SEQ ID NO: 261901 - DNA, 517 bp, Homo sapiens
  misc_feature: GYAE6OF01B7ZDH.16.46.E02.1.454.CMB.1.raw
  modified_base (389)..(389): a, c, t, g, unknown or other
  misc_feature (389)..(389): n is a, c, g, or t
  modified_base (454)..(454): a, c, t, g, unknown or other
  misc_feature (454)..(454): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggcgaggctgattatactgcagcttanatacaggcaacattacttttgcttcgactggaccaggtcacgtctaggcacgccaagccaacccntgtcctactctcgttccccgcccttcctcgagtacgtaccactgacgcgggctgggcaacggg

SEQ ID NO: 261902 - DNA, 541 bp, Homo sapiens
  misc_feature: GYAE6OF01EYTGM.16.46.E02.1.454.CMB.1.raw
  modified_base (506)..(506): a, c, t, g, unknown or other
  misc_feature (506)..(506): n is a, c, g, or t
tcagtgtactactccacgaccggtgctcgatttagactcatctacagggaaagggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttatactgcagtcttatatacaggacaactaatactttttgtctttacggaactgggaaccaaggtccaccgtcctaggtccagcccaaggcccaacccactcgtcaactcctcgtttccccgcccttccncgacgtacgtacacgttgacgcggctggcaacggg

SEQ ID NO: 261903 - DNA, 534 bp, Homo sapiens
  misc_feature: GYAE6OF01CAJEH.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacaatcagtcaccatctcctgcactggaaccagcagtgacgttggtagttataaccgtgtctcctggtaccagcacgcccccaggcacacgcccccaaatcatgatttatgaagtcagtaatcggccctcgaggggtccctgatcgcttctctgggtccaagtctggcaacacggcctccctgaccatctctcgggctccgaggctgaggacgaggctgattattactgcagtcttatatacaggcaactaattacttttgtcttcggaacgtggaccaaggtcaccgtctagtcacgacccacggcccaaccccactcgtccactcctccgtccccgccctcctcgagtacgtacactcgagcgggctggcacgg

SEQ ID NO: 261904 - DNA, 518 bp, Homo sapiens
  misc_feature: GYAE6OF01AJ96C.16.46.E02.1.454.CMB.1.raw
  modified_base (511)..(511): a, c, t, g, unknown or other
  misc_feature (511)..(511): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggagtcccctgatcgcttctctgggtccaagtctggcaacacggcctccctgaccatctctgggctccgaggctggaggacgaggctgatttattactgcagcttatatacaggcaacattacttttgcttcggaactggaccaggtcaccgtctaggtcagcccaaggcccacccactcgcactctcgttcccaccctcctcgagtacgtacactgagcggngtggacg

SEQ ID NO: 261905 - DNA, 515 bp, Homo sapiens
  misc_feature: GYAE6OF01B3QJE.16.46.E02.1.454.CMB.1.raw
  modified_base (419)..(419): a, c, t, g, unknown or other
  misc_feature (419)..(419): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtctctaagcggccctcaggggtatctaatcgcttctctggctccaagtctggcaacacggcctccctgaccgtctctggcctccagactgaggacgaggctgattattactgccactcatatagaagtagtactactctgtgtttcgnggaggacagctgaccgtctaggtcacgcccaaggctcgcccctggtcactctcgttccccgccctcctcgagtacgtacactgagcggcgtggacg

SEQ ID NO: 261906 - DNA, 590 bp, Homo sapiens
  misc_feature: GYAE6OF01CJYK1.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaatcatgatttatgaagtcagtaactccggccctcgaggggtccctgactcgcttctcgtgggtccaagtctgccaacacggcctccctgacctatcctcgtcgggcctccgaggctaggaggacgaggctgtattattactgctagtcttatatacgagactaaacgtaatttacgtttgtacgttacggaactcgggaactaaggtcctaccgtccgtaggtccacggacccaacggcccaacccctctacgtccctacctccgttccgttcccccgtcccttaccgtacggtacgtacgtaccacgtcggacggcgggtctgggcgaacggg

SEQ ID NO: 261907 - DNA, 599 bp, Homo sapiens
  misc_feature: GYAE6OF01CSU44.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcacacgacccccaaatcatgtatttatgaagtcagtaatccggccctcgacgggtccctgactcgcttctcgtcgggtccaagtctggacaacgacggccctccctgaccatctcgtcgggcctccgaggtctggacggacgaggctgtatttattacgtgcacgtcttaatatacgaggacaaactatttacgtttgtccttacggaacgtcgggtaaccaaggtccaccgttcgtacggtaccaacgtcccgaacggaccccaaccctcgtcgtcctaacctccgttcgttcccccgtccctccgtacggtacgttaacgtacctacgtcggacgcgggtctgggacgtaacggg

SEQ ID NO: 261908 - DNA, 552 bp, Homo sapiens
  misc_feature: GYAE6OF01EKBYZ.16.46.E02.1.454.CMB.1.raw
  modified_base (269)..(269): a, c, t, g, unknown or other
  misc_feature (269)..(269): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgatttangaagtcagtaatcggccctcgacggggttccctgatcgcttctcgtgggtccaagtctggcaacacggcctcctgaccatctcgtgggcctcgaggctggaggacgagctgatttattactgctagcttaatatacagactaaactaattcttttgtccttacggaacgtcggactaggtccacgtcctaggtcacgacccaacggcccaacccatcgtcactcgttcgtccccgtccctccgtcgacgttacgtacacgttcggacgcgggctggcgaacgg

SEQ ID NO: 261909 - DNA, 524 bp, Homo sapiens
  misc_feature: GYAE6OF01D7FKO.16.46.E02.1.454.CMB.1.raw
  modified_base (270)..(270): a, c, t, g, unknown or other
  misc_feature (270)..(270): n is a, c, g, or t
  modified_base (469)..(469): a, c, t, g, unknown or other
  misc_feature (469)..(469): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgattttangaagtcagtaatcggccctcaggggtccctgatcgcttctctgggtccaagtctggcaacacggcctccctgaccatctctgggctccaggctgaggacgaggctgattatactgcagcttatatacaggacaacaattacttttgtcttcggaactgggaccaaggtcaccgtctaggtcagcccaaggcccaacccntcgtcactctcgttcccacctcctcgatacgtacactgacgcgggctggcaacgg

SEQ ID NO: 261910 - DNA, 607 bp, Homo sapiens
  misc_feature: GYAE6OF01C143Q.16.46.E02.1.454.CMB.1.raw
  modified_base (530)..(530): a, c, t, g, unknown or other
  misc_feature (530)..(530): n is a, c, g, or t
  modified_base (597)..(597): a, c, t, g, unknown or other
  misc_feature (597)..(597): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttataaccgtgtctcctggtaccagcacgccccaggccacacgaccccaaatccatgtatttatgaagtcaagtaatccggccctcgaggggtccctgactcgtcttctcgtgggtccaagtctggcaacgcggcctccctgacctatctcgtgggcctccgaggctggacggacgaggctagtattagttactgactagtacttaataatacgaaggtactaaactaactttacttttggtacttaccgggaacgttcgggaaccctaacggtacctaccggttcctacggtaccacgtacccgtaacgaccctaaccccgnttacgtcctacctccgttaccgtccccaccctcgtacgtacgttacgtacacgtcggacggcggcgnggtcaacggg

SEQ ID NO: 261911 - DNA, 585 bp, Homo sapiens
  misc_feature: GYAE6OF01B3YWG.16.46.E02.1.454.CMB.1.raw
  modified_base (265)..(265): a, c, t, g, unknown or other
  misc_feature (265)..(265): n is a, c, g, or t
tcagtgtactactccacgaccggtgctcgatttagactcatctacagggaaagggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacagccccaaatcatgatttangaagtcagtaactcggccctcgaggggtccctgactcgcttctcgtgggtccaagtctggcaacgacggcctccgtgaccatctcgtcgggctccgaggctgacggacgaggctagtattattactgctagtcttatactacaggactaaactaatttacgttttgtacgtttacggaacttgggaaccaaggtccaccggtcctaggtcgacgtcccaacggcccaaccccacgtcgtacctaccttcctaccgttacccctcccgttcctacggtacgttactacctaacgtcggacgccgggtctggccgaaacggg

SEQ ID NO: 261912 - DNA, 593 bp, Homo sapiens
  misc_feature: GYAE6OF01D09DD.16.46.E02.1.454.CMB.1.raw
  modified_base (269)..(269): a, c, t, g, unknown or other
  misc_feature (269)..(269): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgaccccaaactcatgatttangaagtcagtaatcggccctcgaggggtccctgatcgctttctcgtgggtccaagtctggcaacgacggcctccctgaccatctcgtgggcctccgaggctggaggacgaggctgatttattactgcagtcttaatactaacgaggacaaactaatttacttttgttccgttaccgggtaactcggggaacctaacggtccaaccgtccgttaaggtccaacgccccgtaaacggccccaaccccgactcgtaccaccttcctccgttccccgcccttcctcggtacgtacgtacacgtcggacggtccgggctgggcgaacggg

SEQ ID NO: 261913 - DNA, 655 bp, Homo sapiens
  misc_feature: GYAE6OF01C10A3.16.46.E02.1.454.CMB.1.raw
  modified_base (334)..(334): a, c, t, g, unknown or other
  misc_feature (334)..(334): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagccacgcccccaggcacacgcccccaaatcatgatttatgaagtcagtaatccggccctcgacggggtccctgactcgcttctcgtggtccaagtctggcaacnccggcctccctgacctatcctcgtcgggccttccgaggctggaggacgaggctagtatttattactgactacgtctttaatacgtaacgaggactaaactaatttacttttcgtaccgtttacgggaacttacgggaacctaacgggttccaccgttacccgtaggtacccgacgtaccccgaacggaccccaacccccgtagtaccgtaccctacctttccgtcccgtttacccccgaccccttacccgtacggttaaacggtacgttaaacccctacgtaccggtaacggtccgggaccgttgggaccgtaaaccgggg

SEQ ID NO: 261914 - DNA, 537 bp, Homo sapiens
  misc_feature: GYAE6OF01A1GDC.16.46.E02.1.454.CMB.1.raw
  modified_base (268)..(268): a, c, t, g, unknown or other
  misc_feature (268)..(268): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
  modified_base (528)..(528): a, c, t, g, unknown or other
  misc_feature (528)..(528): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaatcatgatttangaagtcagtaatcggccctcgacgggtccccatcgcttctcgtggtccagtctggcaacgacgcctcctgaccatctcgtcgggcctccgaggctggacggacgaggctagtatttatacgtgactagtcttatatacgagactaactaatttctttgtcgttacggaactcgggacctaaggtccaccgtcagtcacgccaacgcccaaccntcgctctctccgtcccnccgtctacgagtacgacacgtgacgcggcncggcaggcg

SEQ ID NO: 261915 - DNA, 563 bp, Homo sapiens
  misc_feature: GYAE6OF01BJQPB.16.46.E02.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaatcatgatttatgaggcaataagcgccctnaggtagtttcaatcgcttctctggctccacgtctggacacaccggcctccctgacatctctggcctcnggctgaggacgagctgtattatactgctgtctcatattcaagtcgtgtctacgttatcgttcgttttcgggcgggtagggtaaccgtaagggtacgtacccggtacgtacggtaccgacgaccgacggtcctccgccccgtcggtcctacgtccgttccgtccccgtccctcccgtacgacgttacgtacctacgtcggcggcgggtcg

SEQ ID NO: 261916 - DNA, 647 bp, Homo sapiens
  misc_feature: GYAE6OF01ANOWY.16.46.E02.1.454.CMB.1.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
tcagtgtactactccacgaccggtgctcgatttagactcatctacagggaaagggctgtgcctgggctctgctcctcctcaccctcctcactcagggcacaggatccgtgggctcagtctgccctgactcagccctccctccgtgtccgggtctcctggacagtcagtcaccatcctcctgcacgtcggaaccagcagtgtacgttggtagttactaaccgtgtcctccgtggtaccagccaccgcccccgaggccaccaccgacccccaaatcatgtatttangaatcagtactccggccctggacgggtcccngactcgtcttctcgtcggtaccagtctcgacaaccgccggtccctccgngacctatccgtcgtcggcctacgaggtctaggacggacgagtctagtatttactacgtgactagtacttaatacgtacgaacggtactaaacttaactttacgttttcgttaccgttacggaacgttacggaaccgtaacggtccctaccggttcgtaacggtccgaccgtacccgaaccgtaccccaaccccgtacgtccgtacctaccgttccgttcccgtccccgtcccttccgtacgtacgttacgtaccacgtcggacggccggcgtcggcgtacggg

SEQ ID NO: 261917 - DNA, 882 bp, Homo sapiens
  misc_feature: GYAE6OF01CWKZP.16.46.E02.1.454.CMB.1.raw
  modified_base (555)..(555): a, c, t, g, unknown or other
  misc_feature (555)..(555): n is a, c, g, or t
tcagtgtactactccacgaccggtgctcgatttagactcatctacagggaaaggggctgtgcctgggctctgctcctcctcaccctcctcactcagggcacaggatccgtgggctcagtctcgccctgactcacgccctccctccggtcggtccgggtctcctggacagtcacgtccaccactcctcctcgaccacgtacggaaccaggcaggtggtacggttaggttagttaacgtaaccggtcgttcctccgttacggtaaccgacgccgaaccgccccgacggaccaaccgaaccgaacccccaaactccaattagttatttagtagtaacgtacctaacggttaaccgtccggccccgtacgggtaccggggtaccctggacttccgttccgtttccgtaccggttacgggtaaccgtaacggttccgtacggaccctaaaccggcccggtacccctacccgtacgaacccgtacgtccgttacggtccgggcctaccggacggcgtacgggacgggtacgacggttcgtacgttaaactttacgttacgngtacctaaggtttacttaacgtacgtaacgaacgtaacctaaactttaacgttttccgttttggtaacccggttaggaacccgtacggggtaaacccttacggggtaccccttaacccgggttccggtaacggtcccaaacccggtaccccgaaacccggtaccccctaaaccccggttacgttacccgtaacctaccccttcccgggtttcccccgttacccccggtaccccttacccgggttaacggttacccggttaaaccgtacccggacgggttaaccggggaccgggtcccggggtacgtacggggaaccccgtaacgggg

SEQ ID NO: 261918 - DNA, 702 bp, Homo sapiens
  misc_feature: GYAE6OF01D6Q64.16.46.E02.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagtgtactactccacgaccggtgctcgatttagactcatctacagggaaagggctgtgcctgggctctgctcctcctcaccctcctcactcagggcacaggatccgtgggctcagtctgccctgactcacgccctccctccgtgtccggtctccgtggacagtcagtccaccatcctcctgcacgtaggaaccagcagtgtacgttggtagttactaaccgtgtcctccgtggtaccagccaccgcccccgaggccaccaccgaccccaaactcatgtatttangaatcagtactcgcctgacgggtccagctctcttctcgtcggtacagtctgacaacgccgcctaccgngacctatccgtcgcgggcctaccgaggcgtagacggacgagtctagtatttactacgtgactagttacttaatagtaacgaggtaacctaacgttaattttaccgtttcgtaccgtttaccggtaacgttaccgggaaccgttaacggtcccgtaacccgttccgttaacggacccgtaacccggaaccccgtaaccggacccccaacccttacgtccggttaaccctacctttccccgtacccgttaccccccgtaaccctttaccggtaacgttaaaccggttacccgtaaacctccgggttacgggaccgggtacccgggtacgtacgggacccgtaaaccgggg

SEQ ID NO: 261919 - DNA, 582 bp, Homo sapiens
  misc_feature: GYAE6OF01EQ81D.16.46.E02.1.454.CMB.1.raw
  modified_base (266)..(266): a, c, t, g, unknown or other
  misc_feature (266)..(266): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
tcagtgtactactccacgaccggtgctcgatttagactcatctacagggaaaggggctgtgtctgggctctgctcctcctcaccctcctcactcagggcacaggatcctgggctcagtctgccctgactcagcctccctccgtgtccgggtctcctggtcagtcgatcaccatctcctgcactggaagcggcagtgatgttggggttataaccttgtctcctggtaccagcagcacccagacaaacgcccccaaatcatgatttangaggcaataagcggccctcaggtagtttctaatcgtcttctcgtggctccacgtctggcaacncggcctcctgacatctctcgcctcnggctgacggacgaggctgtatttattactgtctcgctactatacttacaagttcgtgtactacttatcgttcgttttgggacgggtagggaccgtaagggtacgtacccgtaccgtacggtaccgacgacccgtaacggtccgtccgtcccccgtcggtcctaccgtccgttccgttccccgtccccttccgtacgtacgtacgtactacgtcggcggtcgggtccgg

SEQ ID NO: 261920 - DNA, 634 bp, Homo sapiens
  misc_feature: GYAE6OF01EBAK1.16.46.E02.1.454.CMB.1.raw
  modified_base (268)..(268): a, c, t, g, unknown or other
  misc_feature (268)..(268): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttataaccgtgtctctggtaccagcacgccccaggcacacgaccccaaatcatgtatttangaagtcaagttaattcggccctgacggggtccctgactcgtcttctcgtgggtaccaagtcgtggaccaacgacggtccctccctgacctatcgtcgtcgggcctccgaggtctggacgggacgagggtctaggtaatttacttacgtcgactacgtacttataactaacgacggaactaaactaactttacgtttttcgtacgttacggaacgttacgggtaaccgtaacggtaccgtaccggtaccgtacggtacaccggtaccccgaaccggtaccccaacccgtactacgtcctaccgtccttccgttccccgtcccttccgtacgtacgtacgtacacgtcgacggcgggctcggtgacgg

SEQ ID NO: 261921 - DNA, 699 bp, Homo sapiens
  misc_feature: GYAE6OF01DE8SY.16.46.E02.1.454.CMB.1.raw
  modified_base (339)..(339): a, c, t, g, unknown or other
  misc_feature (339)..(339): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtcctcctggtaccagcacgcccccaggcacacgacccccaaatcatgatttatagaagtcaagtaactccggcctcgacggggtcctgactcgcttcgtcgtcggtccaagtctggacaacnccggcctcctgacctctcgtcgtcgggcctccgaggtcgtggacggacgaggctagtaatttacttacgtgactacgtactttaagtaacgttaacgaacgtaactaaacgttaacttttacgttttcgttaccgtttacggtaaccgtacggggtaacccgtaacggtcccgtaaccggttaccgtaacgggttacccaaccggtacccccgaaaccggaccccctaaaccccgtcgttaccgtaccctaccgttcccggttacccgttccccccgacccctttaccgttaccggtaacgttaacccgtaaccgtacgttacgggaaccgggtccgggtaccgtcgggacgtaaccggg

SEQ ID NO: 261922 - DNA, 609 bp, Homo sapiens
  misc_feature: GYAE6OF01BG9RO.16.46.E02.1.454.CMB.1.raw
  modified_base (269)..(269): a, c, t, g, unknown or other
  misc_feature (269)..(269): n is a, c, g, or t
  modified_base (333)..(333): a, c, t, g, unknown or other
  misc_feature (333)..(333): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggccacacgcccccaaatcatgatttangaagtcaagtaatcggccctcgaggggtccctgatcgcttctcgtgggtccaagtctggcaacncggcctcctgaccatctcgtgggcctccaggctggaggacgaggctgattattactgctagctttatatacgaggactaaactaattacttttgtccgtttacggaaccgtgggaaccctaagggtccaaccggttcctaagggtccaacggtaccccgaaggacccccaaccccgtacgttcgtacctaccttccgtacccgttcccccaccccgttccctacggtacgttaaccgtaccacgtcgggaacggtcgggctacgggccgtaacggg

SEQ ID NO: 261923 - DNA, 746 bp, Homo sapiens
  misc_feature: GYAE6OF01BGSDD.16.46.E02.1.454.CMB.1.raw
  modified_base (280)..(280): a, c, t, g, unknown or other
  misc_feature (280)..(280): n is a, c, g, or t
tcagtgtactactccacgaccggtgctcgatttagactcatctacagggaaaggggctgtgcctgggctctgctcctcctcaccctcctcactcagggcacaggatccgtgggctcagtctgccctgactcagcctccctccgtcggtccgggtctcctggacagtcagtcaccatctcctgcactaggaaccagcaggtgtacgttggtagttaactaccgtgtcctcgtggtaccagccaccgccccgagcaccaccgacccaatcatacgtatttangaagtcagtacgccgcctgacgggtcctgactcgtcttcgtcgtacggttaccaggttcgtacggaccaaaccgtacccggtcccttacccgacgtacctacgttcccgttcggtcgggtaccttaccggaggtaccgttaggggaaccgggtaccgggtacggttccgtttaaggttaacgtttttacgtaccggtacgtaccgtaacggttacctttaacgtaacgtaaccggtaacgtaacctaaacgtttaacgttttacgttttacgtaccggttaacggtaacggttacggaaaccgttacgtacccgttaccgtaccgtacgtaccgaccgtacccgtaaccggaccccacccgtactcccggtaccttacccgttcccgttaccccgtcccgttaccggtacgtacgttaccgactaccggtacggaccgtccgggtagtacggaccggtacggaccg

SEQ ID NO: 261924 - DNA, 649 bp, Homo sapiens
  misc_feature: GYAE6OF01BC748.16.46.E02.1.454.CMB.1.raw
  modified_base (268)..(268): a, c, t, g, unknown or other
  misc_feature (268)..(268): n is a, c, g, or t
  modified_base (388)..(388): a, c, t, g, unknown or other
  misc_feature (388)..(388): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcacacgaccccaaatcatgtatttangaagtcaagtaatccggccctcgacggggtccctgactcgtcttctcgtgggtaccaagtctggacaacgacggtccctcctcgacctatcgtcgtcgggctccgaggctggacggacgnggtctgtattacttacgtgctagtcttaatagtacaggactaaactactttacttttcgtacgttacggtaacgtcgggaaccgtaacgtcccaccgttccgtacggtccgaccgtacccgaacggaccccaaaccccgtacgttcgtaccaaccgttccctacccggtttaccccctaccccgttcccgttacggtaaacttaccggtaaccgtaccgttacggacggggtacccgggtcttaccgggacgtaaaccggg

SEQ ID NO: 261925 - DNA, 745 bp, Homo sapiens
  misc_feature: GYAE6OF01B38TX.16.46.E02.1.454.CMB.1.raw
  modified_base (270)..(270): a, c, t, g, unknown or other
  misc_feature (270)..(270): n is a, c, g, or t
  modified_base (362)..(362): a, c, t, g, unknown or other
  misc_feature (362)..(362): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgacccccaaatcatgtatttangaagtcaagtaatccggccctcgacggggtccctgactcgtcttcgtcgtcgggtacctaagtcgtaggacaaccgacggccccttacccgngacctagtcctacgtcggggccttccgaggtctacggagggaccggaaggtcttaggtaatttaacgttacgtgtacctaggtctttaataactacgaacggtactaaacgttaactttacgttttcgtaccgtttacggaaccgttacgggtaaccctaacgggtcccgtaacccggttaccgtaacgggttacccgaaccggtaccccgaaccgggtaccccctaaacccccgtacgttaccggttaccttaccgtttacccgttacccggtttccccccggtacccctttacccggtaaccggttaccggttaaaccgtaacccgtaaccgttacgggtaaccgggtacccgggtccgtacgggaaccggtaaaccgggg

SEQ ID NO: 261926 - DNA, 522 bp, Homo sapiens
  misc_feature: GYAE6OF01A831K.16.46.E02.1.454.CMB.1.raw
  modified_base (266)..(266): a, c, t, g, unknown or other
  misc_feature (266)..(266): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (510)..(510): a, c, t, g, unknown or other
  misc_feature (510)..(510): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcacacgccccaaatcatgatttangaagtcagtaactccggccctcgacggggtccctgactcgtcttctcgtgggtccaagtctggacaacgcggcctccncgaccntctcgtcggctcgaggctggaggacgagctagtacttattacgngctagtcttatatacagacaactattctttgtcttacggactggactagtccacgtcagtcacgccacgcccaaccntcgcactctcgtcccncctcncgatacacacgtggacgnggctggcgacgg

SEQ ID NO: 261927 - DNA, 699 bp, Homo sapiens
  misc_feature: GYAE6OF01E1NSN.16.46.E02.1.454.CMB.1.raw
  modified_base (280)..(280): a, c, t, g, unknown or other
  misc_feature (280)..(280): n is a, c, g, or t
  modified_base (368)..(368): a, c, t, g, unknown or other
  misc_feature (368)..(368): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccggtgtccgggtctccgtggacagtcagtcaccatctcctgcactggaaccagcagtgtacgttggtattactaaccgtgtctcctggtaccagcaccgcccccaggaccacgaccgacccccaaactcatagtatttanagaagtcagtaactccggccctcggacgggtccctgactcgtcttcgtcgtcgggtactaacgtctcggacaacgaccgtccctaccncgacctacttccgtacggtcgggtcctaccggacggtcgtaggacggtaaccggaggtcttagttaactttacgttacgtgacgtagttacttaatacgtacgacgtaactaacttaactttacgtttcgtaccgttacggaacgtacgggtaaccgtaacggttccctaccggtaccgttacgacccgaaccggtaacccgaacccggacccctaaccccgtcgttacgtccctaccgttcccgttacccgttcccccgtccgttaccgttaccggtagttacccgacgtaccggtcggacgggtaccggtcggtacggacggtaacggg

SEQ ID NO: 261928 - DNA, 630 bp, Homo sapiens
  misc_feature: GYAE6OF01BT10S.16.46.E02.1.454.CMB.1.raw
  modified_base (267)..(267): a, c, t, g, unknown or other
  misc_feature (267)..(267): n is a, c, g, or t
tcagtgtactactccacgaccggtgctcgatttagactcatctacagggaaaggggctgtgcctgggctctgctcctcctcaccctcctcactcagggcacaggatcctggactcagtctgccctgactcagcctccctccgtgtccgggtctcctggacagtcagtcaccatctcctgcactggaaccagcagtgacgttggtagttataccgtgtctcctggtaccagcacgccccaggcacacgaccccaaatcatgtatttangaagtcagtaactccggccctcgacggggtccctgactcgtctttcgtcgtcgggtaccaagtctggaccaacgccggcccttcccgtacgacctagtccgtcgtcgggcctccgaggtcgtaggacggacgacggtctagtatttacgtactgactagtcttagtactacgacgactaaactaatttcgttttacgtacgttaccggtacgtacggaacctaacggtcctaccgtccgtacggtacacgacccgaacggccccaacccgtactccgtacctaccgttcctacccgttccccgtacccttaccgacgtaacgtaccgtaccgtacgtcggaccggacgggtctggacgtacgg

SEQ ID NO: 261929 - DNA, 712 bp, Homo sapiens
  misc_feature: GYAE6OF01C7TI9.16.46.E02.1.454.CMB.1.raw
tcagtgtactactccacgaccggtgctcgatttagactcatctacagggaaaggggctgtgcctgggctctgctcctcctcaccctcctcactcaggcacaggatcctgggctcagtctgccctgactcagccctccctccgtgtccgggtctccgtggacagtcagtcacctatctcctgcactggaaccagcagtgacggttggtagttaactaccgtgtcctccgtacggtaccagccacgccccaggccaccaacgacccccaaactcagtcgtatttagagaagtctaagtacgtccggccctacggtacggggtccctgtactcgtcttctcgtcggtacctaagtcgtaggaccaacgaccggtcccctcctagacctacttccgtcgtcgggtcctccgaggtcgtaggacgacgtaggtcttagtacttacgtacgtcgactagtacttaagtaactacgtaacggtaactaaacgtttaaactttacgttttacggttacttaaccgggtaccgtacgggtaaacccgtaacggtacccgtaacccgttaccggtaccggttaccgaaccgtaccccgtaaacccgggtacccctaaccccggtatcccgtactacccttacccgttcccgtacccccgtcccgttacctacgtacgttaccgtactaccgtacggtacgggccggtacgcggacgtaacgg

SEQ ID NO: 261930 - DNA, 840 bp, Homo sapiens
  misc_feature: GYAE6OF01EFTP4.16.46.E02.1.454.CMB.1.raw
  modified_base (191)..(191): a, c, t, g, unknown or other
  misc_feature (191)..(191): n is a, c, g, or t
tcagtgtactactccacgaccggtgctcgatttagactcatctacagggaaagggctgtgcctgggctctgctcctcctcaccctcctcactcagggcacaggatcctggctcagtctcgccctgactcacgcctccctccgtgtccggtctccgtggacagtcagtcaccatcctcctgcactggaaccngcagtgtacgttggtattataaccgtgtctcctgtaccagccaccgccccaggccacgaccgacccccaaatcatgtatttagagaagtcaagttaacgtccggccctcgacgggtccctgactcgtcttccgtcgtcggtacctaaggtctacggaccaacgtcccggtccctccgtacgacctacgttccgtcggtcgggtcctacccggtaggtaccgtagggaacgggtaaccggtacggtccttaagttaacgttttaacgttaccgtagtaaccgtacgttaaccgtttaacgtaacttaaccgaacggtaaacctaaaccgtttaacgttttacccgttttttacgtaccggtttaaccgggtaaaccggttaccgggtaacccgttaaccgggttacccgtaacccggttaccgttaaccgggttacccgaacccgggtaacccccgtaaacccgggtaccccctaaacccccgtacgttacccggttaaccccttacccgtttacccgttacccccgtttaccccccgtaacccccgtttacccggttaaccggttaaccgttaaaccggttaaccctaacccgggttacgggaacccgggtcccggggtaaccgttccggggaacccggtaaacccggg

SEQ ID NO: 261931 - DNA, 723 bp, Homo sapiens
  misc_feature: GYAE6OF01DDZHF.16.46.E02.1.454.CMB.1.raw
  modified_base (268)..(268): a, c, t, g, unknown or other
  misc_feature (268)..(268): n is a, c, g, or t
  modified_base (343)..(343): a, c, t, g, unknown or other
  misc_feature (343)..(343): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcacgtggaaccagcagtgacgttggtagttactaacgtgtctcctggtaccagcacgccccagcacacgccccaaatcatgtactttanagaagtcagtactcggccctgacgggtcctgactcgcttctcgtggtaccagtctgacaacgccgtcctccgtanacctatctcgtcggctcgacggctaggacggtacgacggtctacgttattacgttacgacgtacgtattaccttaaagtaaccgtaacggtaagtaaaccttaaatttaaccgttttacgttttacgttaccggttaaacccgggtaacggttaaccgggtaaacccgttaacgggttacccgttaacccggtttacccggtaacggttacccgaaccccgggtaaccccgaaacccggtacccccgttaaccccgacgttaccgtaacccttacccgttacccgttacccgtacccccgttacccgttacggttacggtaaccggttaaccgactacccggtacgggaccgggttacgggccgttacggacggaaccgg

SEQ ID NO: 261932 - DNA, 718 bp, Homo sapiens
  misc_feature: GYAE6OF01DHY7K.16.46.E02.1.454.CMB.1.raw
  modified_base (180)..(180): a, c, t, g, unknown or other
  misc_feature (180)..(180): n is a, c, g, or t
tcagtgtactactccacgaccggtgctcgatttagactcatctacagggaaaggggctgtgcctgggctctgctcctcctcaccctcctcactcaggcacaggatcctggctcagtctgccctgactcagccctccctccgttcggtccggtctccgtggacagtcagtcacatctcctncactgaaccagcagtgacgttggtagttataaccgtgtctcgtggtaccagacacgccccaggccacgaccgaccccaaaatcatagtaattttaagtagaacgttcaagtaacgtccggacccgttacggaccgggggttacccctaagtccgtcgtttccgttcgtacggggtaccctaaacggttcgtcggaaccgaaaccgccggtcccctacctacgacctacttccgtcgtacgggtacctacgaggtctagggaacggacgtaggtctagttaattactacgtgactatacgttaatagaaccgtaggacctaaagtaactttcgtttacgtaccgttacggtaaccgtacgggtaacctaacggtaccctaccggttaacgtacggtaccaaacggccccgtaaaccggccccaaacccgttacgttacgtcccgtaaccgtttccgtacccgtttccccggtacccttaccggtacggtaacgttacggaaccgtacggtcggacggtcggcggtaacgacgcggtacg

SEQ ID NO: 261933 - DNA, 677 bp, Homo sapiens
  misc_feature: GYAE6OF01D8TKS.16.46.E02.1.454.CMB.1.raw
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcacacgacccccaaatcatgtattttangaagtcaagtaactccggccctcgacggggtccctgactcgtcttctcgtcgggtccaagtctggaccaacgccggccctccncgacctatcctcgtcgggcctccgaggctaggacggacgaggtctagtaactttattactgacagttactttaatacttaaccgaggtaacctaaacttaacttttaccgtttttcggttacctttaaccggggtaacgtaccggggaaaccctaacgggttcccaacccgttccgtaacggtccgaaccggtaccccgaaaccggacccctaaaccccgtcgttacgtcctaccgttccgttacccgttacccccgtacccttaccctacgtaccgttaacgtacccacgtacggacggtccgggtacgtggaccgtaacggg

SEQ ID NO: 261934 - DNA, 657 bp, Homo sapiens
  misc_feature: GYAE6OF01BI4J5.16.46.E02.1.454.CMB.1.raw
  modified_base (273)..(273): a, c, t, g, unknown or other
  misc_feature (273)..(273): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtcctccgtggtaccagccacgcccccaggcacacgacccccaaatcatgtatttangtaagtcagtaactccggccctcgacgggtccctgactcgtcttctcgtcgggtccaagtcgtggacctaaccgaccggtccctccctgacctatcctcgtcggcctccgaggctaggaacggacgaggtctagtatttacttactgactagtcttaagtactacgagtactaaacgtaatttacgttttcgtacgttacggaaacgttcgggaaccttacggtacccgtaccgttaccgtaggtaccaccggtacccgaacggaccccctaaccccgtataccgtacctacccttccgtacccgttacccccaccccgttacgtaccggtaacgttaccgtaccgacgtacggacggtaccgggtccgtcgggtacgaacggg

SEQ ID NO: 261935 - DNA, 912 bp, Homo sapiens
  misc_feature: GYAE6OF01EGE7P.16.46.E02.1.454.CMB.1.raw
tcagtgtactactccacgaccggtgctcgatttagactcatctacagggaaagggctgtgcctgggctctgctcctcctcaccctcctcactcagggcacaggatccgtgggctcagtctcgccctgactcagccctccctccgtcgtccgggtctccgtggacagtcagtcaccatcctcctgcacgtacggaaccagcgtaggtgtacggtttggttaagttacgtaaccgttgtcctccgtaggtaccacgccaccgccccgaggaccacaccgaccccctaaatctaattagttatttagagtaacgtactaagtacgtccggacccgttggaccggggttccctgtacgtccgttcctttacgtcgttaccgggtacctaaggttccgtacgaccaaccgtacccggtccccttaccgtacgaacctcgttccggtccggtcgggtacccgtaccgggaagggtccgtacggggaacgggtaacgggtacggttacttaaggttaaccgttttaacgtaccggtcgtaaccgttaagtttaccgtttaaagtaaaccggtaacgtaaaccggttaaccttaaaacgtttaccgttttttacgttttaccggttaacccggtttaaaccggggttaaaaccgttacccggggttaaaccgttaacccggttcccgttaacccggttaccggtaaccgggtaacccgtacccggtaaaaccccccggtaacccggtaacccccctaaccccgttacgttacccgtaccccgttaacccgtttccccggttaaccccggttcccccccgttaccccgttaggttaacccggttaaaccgggtttaacctacccgggtacgttacccggggacggtacccggggtccggttaaccgggacggtaacccggg

SEQ ID NO: 261936 - DNA, 684 bp, Homo sapiens
  misc_feature: GYAE6OF01CLWHG.16.46.E02.1.454.CMB.1.raw
  modified_base (356)..(356): a, c, t, g, unknown or other
  misc_feature (356)..(356): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttataaccgtgtctcctggtaccagcacgcccccaggcacacgacccccaaatcatgtatttatagaagtcagtaatccggccctcgacggggtccctgactcgtcttctcgtcgggtaccaagtctaggacaacgaccggccctcccngacccatcctcgtcgggcctccgaggccgtaggacggacgaggcttagtatttaacttacgtcgacgtacgtactttaatacgtaacgacggaactaaactacgtttacgttttcgtaccgttacggaaccgttcgggaaccctacggttacctaccggtaccgtaggtacccgaacgaccccgtaacggacccctaaccccgtgttaccgtacctacccttacccgttaccgttacccccgtaccccttacccgttaccggaacgtttaaccgtaccgtaaccgtacgggaccggaccgggttaccgtcgggtaccgtaaaccgggg

SEQ ID NO: 261937 - DNA, 715 bp, Homo sapiens
  misc_feature: GYAE6OF01BE7IS.16.46.E02.1.454.CMB.1.raw
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctcctccgtgtccgggtctcctggacagtcagtcaccatctcctgcactggaaccagcagtgacgttggtagttataaccgtgtctcctggtaccagcagcccccaggcacacgccccaaatcatgatttangaagtcagtaatcggccctgacgggtccctgatcgcttctcgtggtccagtctgcaacncgcctcctgaccatctcgtcgggctccaggtcgtgacggacgtaggtcctagtatttacgttacgtgtactaggtactttaattaacgttaaccgaacgggtacctaaacgttaaacgtttacgtttttacggtaccgtttaaccggtaaccgttacgggtaacccgtaacgggtaccctaacccggttacctaacggggttcccgaacggtaccccgtaaacggaccccgtaaacccccctacgtacccggttacctaacccgtttcccgtacccgtttaccccccgtaacccgttaccccgttacccggttaacggttaacccgttaaccccgtaaccggttacggttaacccggcccggggttacgtccggggtaccgtaaaccgggg

SEQ ID NO: 261938 - DNA, 723 bp, Homo sapiens
  misc_feature: GYAE6OF01E0CU7.16.46.E02.1.454.CMB.1.raw
  modified_base (400)..(400): a, c, t, g, unknown or other
  misc_feature (400)..(400): n is a, c, g, or t
  modified_base (688)..(688): a, c, t, g, unknown or other
  misc_feature (688)..(688): n is a, c, g, or t
tcagtgtactactccacgaccggtgctcgatttagactcatctacagggaaagggctgtgcctgggctctgctcctcctcaccctcctcactcagggcacaggatcctgggctcagtctcgccctgactcagccctccctcgtgtccggtctccgtggacagtcagtcaccatcctcctgacactaggaaccagcagtgtacgttggtaagttactaaccgtgtcctccgtaggtaccagccacgccccaggccacaccgacccccaaatcatagtatttagagaacgtcaagttaacgtcccggcccgtcgacgggttcctgactccgttctcgtcgtgggtaccaggtctacgacaaccgccgtcctcccgtacgacctactccgttcgcgggtaccnccgaggtcgtaggaacgggacgagtcttaggttaactttaacgtcgtagtactagtacttagtaacgtaacaacggtacttaaacgttaacgttttactttttccggtaaccgttaaccgggtaacgtaccggggtaaaccctaacggtttccccgaaccgtttaccggaaccgtacccgaaccgtacccggtaaacccggtaccccctaaccccgttagtcccgttacctaccgtttccccggttacccttaccccggtcccttccggtaccggaatttaccgaccncgttacgggccggacggtcggtacgaccggtacgg

SEQ ID NO: 261939 - DNA, 734 bp, Homo sapiens
  misc_feature: GYAE6OF01A9P91.16.46.E02.1.454.CMB.1.raw
  modified_base (269)..(269): a, c, t, g, unknown or other
  misc_feature (269)..(269): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctgtaccagcacgccccaggccacacgaccccaaactcatgtatttanagaagtcaagtaactccggccctagacggggtccctgactcgctttctcgtcgggtaccagtcnggacaacncggcctcctgaccatctcgtgggcctcgaggtctaggacggacggaggtctagtactttacgttacgtgtctacgtactttaagtaacttacgaacggaacctaaaacgttaacgttttactttttacggtacctttaacgggaaaccgtacggggtaacccttaacgggttcccgtaaccggttcccgtaacgggttacccgaaccggtacccccgaaaccgggtacccccctaaacccgtaccgtttaccggttacccttacccgttacccggttaccccggttacccccccggtacccctttaccccgtaaccgggttaaccgttaaccggtacccgtaaccggttcgggaacccgggtcccggggtacgtacggggaccgtaaacgggg

SEQ ID NO: 261940 - DNA, 781 bp, Homo sapiens
  misc_feature: GYAE6OF01AZQI9.16.46.E02.1.454.CMB.1.raw
  modified_base (271)..(271): a, c, t, g, unknown or other
  misc_feature (271)..(271): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggccacacgaccccaaactcatgtatttangaatcaagtaatcggaccctggacgggtccctggacttcgctttctcgtcgggtacctaagtctaggaccaacgtccggcctccctgacctatctcgcgggctacgaggctaggacggacgcgtctagtatttacttacgtggactacgtacgtttaatacgtaacgtaacggtacctaaaacgtttaaacgttttaccgttttttaccgggtaccggttttaccgggtaaaccggtttaccgggggtaacccgttaaacggggttccccgttaaccccggttacccggtttaacgggttaccccgaaaccgggttaaccccccggaaacgggtaaccccccttaaaccccccggttacgttaccggttacccctaaaccggtttccctttaaaccccgtttcccccccggtaaccctttaccccggtaacggttaaccgttaacccgggttaacctaccgggtacgggtaccgggtacccggggttaccggtacggtcggaaaccgggg

SEQ ID NO: 261941 - DNA, 768 bp, Homo sapiens
  misc_feature: GYAE6OF01CJQTQ.16.46.E02.1.454.CMB.1.raw
  modified_base (274)..(274): a, c, t, g, unknown or other
  misc_feature (274)..(274): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgtacgttggtagttataaccgtgtcctccgtggtaccagcacgcccccaggccacacgacccccaaatcatgtatttanagtaagtcaagtaacgtccggccctcgtacggggtccctgactccgtcttcgtcgtcgggtaccagtctggaccaacgccggccctccctacgacctattccgtcgtcgggccctccgacggtcgtaggacggacggacggtcttaggtaactttacttacgtcgtacgtacgttacctttaagtaacgtaaccgaaggtaacctaaaacgttaacgttttaaccgtttttaggttacccgtttaaccgggtaaccggttaccgggtaaacccgttaacgggttacccgtaaccccggtttaccggtaaccgggttacccgaacccgggtaacccccgaaaccgggtaccccccaaacccccgtacgttacccgtaccctacccgttcccgttccccggttaccccccgtccccgttacccggttacggtaacgttaaccgtaccgtaccgtacgggaccggtcccggggtaccgtacggggaccgtaaccggg

SEQ ID NO: 261942 - DNA, 616 bp, Homo sapiens
  misc_feature: GYAE6OF01BBMA8.16.46.E02.1.454.CMB.1.raw
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttatacgtgtctcgtgtaccagcacgccccaggcacaccgaccccaatcatgtatttagagaagtactaagtacgtccggccctggacgggtcctgactcgtcttctcgtggtaccagtcacgacacgccgcctccgcgaccntctcgtcggccncgaggcgtaggacggacgagtcgtagtatttagttacgngtactagtacttaatagtaacgtacgaactaaacgttatttacgtttcgttaccgtacgtaacggtacggaaccgtacggtcctacgtcgtaggtaccgaacgacccgaaccgtacccaacctcgtactaccgtccgttccgttacccgtcccctaccgtaccgtaacgtacgttaccgtacacggtacggccggtacggtcgcggaacgtacgg

SEQ ID NO: 261943 - DNA, 811 bp, Homo sapiens
  misc_feature: GYAE6OF01DG4J4.16.46.E02.1.454.CMB.1.raw
tcagtgtactactccacgaccggtgctcgatttagactcatctacagggaaaggggctgtgcctgggctctgctcctcctcaccctcctcactcagggcacaggatccgtgggctcagtctcgccctgactcacgccctccctccgtcgtccgggtctccgtggacagtcagtcaccatcctcctgccacgtacgaaccagtcgaggtcgtacggttggtagttacgtaccgtgtctccgtcgtacagccaccgccctagaccaccgaccgaccccaaatcaacgttgtaacttaagtacggaacgttacgaacgttaaccgtcccggacccgtacgggtacggggtccctaggacgttccgttccttacgtcgtccgggtacctagtccgtacgaccaacgcccggtcccctacctacgaacctcgtccgtacggtcggaccctaccggagtcgtacggacggacggtacgtcttaagtacgtttactacgcgtactaagttaccttaataacgtacggtacaaacgttaacttttaagtttaccgtttacggttaaccgggttaaccggtaacgttacccggggaaaccgttacggtacccggtacccggttaacgttaaccgggcccctaaacccgggtaacccgaaacccggtaccccctaaacccgtcggttaccctaacccgttaccgtttccccgtaccccgtttaaaccccccggcccgtttaacgaccgggttaacttaaacccgggtcctaaccggggtaacgggtcccgggtaccgggcggttaaaccgggaacggacgg

SEQ ID NO: 261944 - DNA, 621 bp, Homo sapiens
  misc_feature: GYAE6OF01B0EYI.16.46.E02.1.454.CMB.1.raw
  modified_base (277)..(277): a, c, t, g, unknown or other
  misc_feature (277)..(277): n is a, c, g, or t
  modified_base (359)..(359): a, c, t, g, unknown or other
  misc_feature (359)..(359): n is a, c, g, or t
  modified_base (586)..(586): a, c, t, g, unknown or other
  misc_feature (586)..(586): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatcctcctgcacgtggaaccagcagtgacgttggtagttactaaccgtgtcctcctggtaccagcaccgccccaggccacaccgacccccaaatcatgtatttangaagtacagtaactccggccctcggacgggtccctgactcgtcttcgtcgtcggtaccagtctgaccaacgccgtcctccgngacctatcgtcgtcggcctccgagcgtaggacggacgaggtctagtatttacgttactcgactacttcctactaacttaactaaaccaaaccaacacgacctactaccgtaccgtacgttaggttacgttcgggaccgggtacggaaccacgtccgtaccgtaccgtcgtacgcgaccgaccgacgtccgtcccgccccgtcgtcctaccgttcctcccgttccccncccgtccgtacgtacgtactcgtacgtcggacggg

SEQ ID NO: 261945 - DNA, 643 bp, Homo sapiens
  misc_feature: GYAE6OF01CAHLH.16.46.E02.1.454.CMB.1.raw
  modified_base (189)..(189): a, c, t, g, unknown or other
  misc_feature (189)..(189): n is a, c, g, or t
  modified_base (633)..(633): a, c, t, g, unknown or other
  misc_feature (633)..(633): n is a, c, g, or t
  modified_base (637)..(637): a, c, t, g, unknown or other
  misc_feature (637)..(637): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcacgcctcctccgtgtccggtctcctggacagtcagtcaccatcctctgcactggaaccngctagtgtacgttggtagttaactaaccgtgtcctcgtcggtaccagccgaccgccccaggccaacgaccgaccccaaaatcatacgtatttacgagtaagtcaagtacgtccggccctcgtaccggggtcctagacttccggtcctttcgttcgtcgggttacctaaggtcgtcgaccgaaaccgtcccggtcctccgtcgacctactctcggttcgggaccctccggacgcgtaggaacgggacgacggtcgtagttacgtttactacgtacgctaacgttcttaatacacgaacgtactaaacttatttactttgtaccgtacggtaacgcggtaacgacgtctaccgtaccgtcgacacgaaccaccgtacctacccgcttcgctaccgtccttacccgtcccacccgttcacgagtaccgactacgtcggacgcggtcncggngtacgg

SEQ ID NO: 261946 - DNA, 709 bp, Homo sapiens
  misc_feature: GYAE6OF01DJS9C.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccggtctcctggacagtcagtcaccatctcctgcactggaaccagcagtgacgttggtagttaactaaccgtgtcctcctggtaccagccacgcccccaggcaccaccgacccccaaatcatagtatttagagaatcgaagtaactccggtaccctcggaccggggtaccctgactccgtcctttcgtcggtcggtacctaagtccgtacggaccaaccgacccggtcccctacctacgacctagttccgtcgtacgggcctaccggaggtcaggacggacgaggtctagtatttactcgtgacgtgttacttaatacgtaacgacgaacttaacgtaacttttacgtttcggttaccgttacgggtaacgtaccgggtaaccgtaaccggttaccgtaccggtttacccgtaacgggtacccaaccgggtaccccgaaccgacccctaaccccgtgtacctacccgtaccttcccgttacccggtcccccgtcccgttacccgttacggaccgttaccgtactaccggtacggtacggccgggtactcgggtacgaaccggg

SEQ ID NO: 261947 - DNA, 965 bp, Homo sapiens
  misc_feature: GYAE6OF01D5YS0.16.46.E02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggaaaggggctgtgcctgggctctgctcctcctcaccctcctcactcaggcacaggatccgtggctcagtctcgcctgactcacgcctcccgtccgtgtccggtctctaggacagtcacgtcacctatcctcctgcacgtacggaaccnggacaggtgtacggtttggttaagttaacttaaccggtgttacctaccgttacgggtaccacggtacgtacggtccctaccgaagggaccaaccgaaacccggttaacccccaaaacgttccgaagtttacggtaaattttaacgtaacggtaaacgttacgtaaaccggttaaaacggttccccggggaccccgtttaccgggtaacccggggggtttcccacgggttaaccgttccgtttacccgttttaccgtaccggggttttaccggggtaacccgtaacggttaccggttaacgggaaccttaaaccccggcccggggttaacccccttaccgtaccggtaacctacggtttcccgtacgggttaccggaccgttaccggtaacgggtcggttaacgggggaacgaacggggtacgttaaccgttacggtaaattttaccgtttagacggttacgaaacgtttaccgttaaattaacgtaaccgtaaacggtaaaccttaaacgttaacggttttacccgttttaggttaacccgttaaacgggtaaccgggtacggtaaacccgttaacggtcccgttaaaccgggtcttaaccgggacccggtaaacgtaccccgtaaaccggacccccctaaacgtccgtaaccgtacttacccgttaacctccccggttacccctaaccccggttaccccaacgggtttacgaaccggttaccgtaaccggttacgggacgggtttaccggacggttacccggaaacgg

SEQ ID NO: 261948 - DNA, 773 bp, Homo sapiens
  misc_feature: GYAE6OF01A0GXK.16.46.E02.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (731)..(731): a, c, t, g, unknown or other
  misc_feature (731)..(731): n is a, c, g, or t
  modified_base (750)..(750): a, c, t, g, unknown or other
  misc_feature (750)..(750): n is a, c, g, or t
tcagtgtactactccacgaccggtgctcgatttagactcatctacagggaaagggctgtgcctgggctctgctcctcctcaccctcctcactcagggcacaggatcctgggctcagtctgccctgactcagcctccctccgtgtccgggtctcctggacagtcagtcaccatctcctgcactggaccagcagtgacgttggtagttataaccgtntctcctgtaccngcacgccccaggcacaccgaccccaaactccatacgtattttacagtaagtacaagttaacgtccggcccgttaccgtacgggggttccctgaccgtccgttcctttcgtccggttacgggtaccgtaacggttcgtacggaacccgaaccgtacccggtccccttacccgtaccgaacctacgttcgtcccgggtcggtccctccggtacgggcttagggaccgggacggtacggtccgttaggttactttaacgtttacctggacctaggttactttaaccgtagtaaacccgaacggtaacctaaaacgttaagtttttaccgttttacggttacccgttaacgggtaccggtaaccggtaaccgttaaccggtacccttaccggttaccggtaacgttaccgaacccgtaccccgtaaccggacccccaacccgttacgccttacccgtaccttccccggtacccgttccccgtacccgtccggtaagtccggttaaccncgttacggcggtacccggngggtaccgtcggaaccggtaccg

SEQ ID NO: 261949 - DNA, 518 bp, Homo sapiens
  misc_feature: GYAE6OF02IYYYY.16.46.E02.1.454.CMB.1.raw
  modified_base (463)..(463): a, c, t, g, unknown or other
  misc_feature (463)..(463): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgcttcggaactgggaccaaggtcacgtctaggtcagcccaaggccaaacccnctgtcactctgttccccaccctcctcgagtagtacactgagcgggctggcaacgg

SEQ ID NO: 261950 - DNA, 529 bp, Homo sapiens
  misc_feature: GYAE6OF02HQJ9H.16.46.E02.1.454.CMB.1.raw
  modified_base (489)..(489): a, c, t, g, unknown or other
  misc_feature (489)..(489): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttattactgcagcttatatacaggcaaacaattacttttgtctttcgaactgggaccaaggtccacgtctaggtcagcccaaggcccaacccactcgtcactctcgttaccccnccctcctcgagtacgtacactggagcgggctggctaacgg

SEQ ID NO: 261951 - DNA, 522 bp, Homo sapiens
  misc_feature: GYAE6OF02IEZJH.16.46.E02.1.454.CMB.1.raw
  modified_base (287)..(287): a, c, t, g, unknown or other
  misc_feature (287)..(287): n is a, c, g, or t
  modified_base (390)..(390): a, c, t, g, unknown or other
  misc_feature (390)..(390): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctnaggggtccctgatcgcttctctgggtccaagtctggcaacacggcctcctgaccatctctgggctccaggctgaggacgaggctgattattactgcagcttanatacaggcaacaatactttgcttaggaactgggaccaaggcacgtcctaggtcagcccaagcccaaccccatcgtcactctcgttacccaccctcctacgacttagtactactcgagcgggactggcaacgg

SEQ ID NO: 261952 - DNA, 515 bp, Homo sapiens
  misc_feature: GYAE6OF02FTPH3.16.46.E02.1.454.CMB.1.raw
  modified_base (456)..(456): a, c, t, g, unknown or other
  misc_feature (456)..(456): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggactgggaccaggtcacgtctagtcagccagccaacccntgtcactctcgttcccgccctcctcgacgtacgtacactgacggcgggctggcaacggg

SEQ ID NO: 261953 - DNA, 521 bp, Homo sapiens
  misc_feature: GYAE6OF02FJN3C.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaggtcaccgtcctaggtcagccaaggccaacccactgtcactctcgttcccgccctcctcgagttacgtacactgacgcgggctggcaacggg

SEQ ID NO: 261954 - DNA, 533 bp, Homo sapiens
  misc_feature: GYAE6OF02ILHXD.16.46.E02.1.454.CMB.1.raw
  modified_base (474)..(474): a, c, t, g, unknown or other
  misc_feature (474)..(474): n is a, c, g, or t
  modified_base (513)..(513): a, c, t, g, unknown or other
  misc_feature (513)..(513): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggccacacgcccccaaaactcatgatttatgaagtcagtaatcggccctcaggggtccctgatcgcttctctgggtccaagtctggcaacacggcctccctgaccatctctgggctccaggctgaggacgaggctgatttattactgcagcttatatacaggacaactaattacttttgtctttcggaactgggaccaaggtcaccgtcctaggtcagcccaaggcccaacccntcgtcactctcgttccccaccctcctcgacgtacgtacnctgacgcgggctggcaacgg

SEQ ID NO: 261955 - DNA, 511 bp, Homo sapiens
  misc_feature: GYAE6OF02F06ES.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggggccctcagggtccctgatcgcttctctggtccaagtctggcaacacggcctccctgaccatctctgggctccagctgagacgaggctgattattactgcagcttatatacaggcaacatactttgtcttcgactggaccagtcacgtcctagtcacgccaacgccaaccccactcgtcactctcgttcccaccctcctcgagtacgtacactcgagcgggctggcacgg

SEQ ID NO: 261956 - DNA, 535 bp, Homo sapiens
  misc_feature: GYAE6OF02HD3CH.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggcctccgaggctggaggacgaggctgatttattactgcagtcttaatatacaggcaaactaattacttttgtctttacggaactgggaccaaggtcaccgtctaggtcagcccaaggcccaacccatcgcactctcgttcccgccctcctcgaagtacgtacacgtgacggcgggctggcaacgg

SEQ ID NO: 261957 - DNA, 521 bp, Homo sapiens
  misc_feature: GYAE6OF02GUHDO.16.46.E02.1.454.CMB.1.raw
  modified_base (463)..(463): a, c, t, g, unknown or other
  misc_feature (463)..(463): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggccctcaggggtccctgatcgcttctctgggtccaagtctggcaacacggcctccctgacccatctctgggctccgaggctgaggacgaggctgatttattactgcagcttatatacaggcaacattacttttgtcttcggaactggaccaaggtcaccgtctagtcagcccaagccaacccntgtccactctcgtcccacctcctcgacgtacgtacactgacgcgggctcggctaacgg

SEQ ID NO: 261958 - DNA, 532 bp, Homo sapiens
  misc_feature: GYAE6OF02JBMCF.16.46.E02.1.454.CMB.1.raw
  modified_base (475)..(475): a, c, t, g, unknown or other
  misc_feature (475)..(475): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatcggccctcgaggggtccctgatcgcttctctgggtccaagtctggcaacacggcctccctgaccatctctgggctcaggctgagacgaggctgatttattactgcagtcttaatatacgaggacaaactaattacttttgtcttacggaactgggaaccaaggtccacgtctaggtcagcccgaagcccaacccnctgctactcttcgtcccgcctcctcgacgtactacactggacgcgggctggcaacgg

SEQ ID NO: 261959 - DNA, 519 bp, Homo sapiens
  misc_feature: GYAE6OF02F32R1.16.46.E02.1.454.CMB.1.raw
  modified_base (266)..(266): a, c, t, g, unknown or other
  misc_feature (266)..(266): n is a, c, g, or t
  modified_base (327)..(327): a, c, t, g, unknown or other
  misc_feature (327)..(327): n is a, c, g, or t
  modified_base (461)..(461): a, c, t, g, unknown or other
  misc_feature (461)..(461): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttangaagtcagtaatcggccctcaggggtccctgatcgcttctctgggtccaagtctggcaacncggcctcctgaccatctctgggcctccgaggctgaggacgaggctgatttattactgcagtcttatatacaggcaacaatacttttgtcttcggaactgggaccaggtcaccgtcaggtcagccagccaacccntgtcactctgtccccacctcctcgagtacgtaccacgtggacgcgggctcggcaacgg

SEQ ID NO: 261960 - DNA, 636 bp, Homo sapiens
  misc_feature: GYAE6OF02JTDYF.16.46.E02.1.454.CMB.1.raw
  modified_base (273)..(273): a, c, t, g, unknown or other
  misc_feature (273)..(273): n is a, c, g, or t
  modified_base (411)..(411): a, c, t, g, unknown or other
  misc_feature (411)..(411): n is a, c, g, or t
tcagtgtactactccacgaccggtgctcgatttagactcatctacagggaaaggggctgtgcctgggctctgctcctcctcaccctcctcactcagggcacaggatccgtgggctcagtctgccctgactcagccctccctccgtgtccgggtctcctggacagtcagtcaccatctcctgcactggaaccagcagtgacgttggtagttataaccgtgtctcctggtaccagcacgccccgaggccacacgacccccaaactcatgatttangaagtcagtaactccggcctgacggggtccctgactcgcttctcgtcggtccaagtctggacaacaccggcctccgtgaccatcctcgtcgggcctccgaggctaggaggacgaggctgtatttactgtcgcagctanataatacgagtcggacagctacttcggtacgttacgttcgggacgggtacgggaccaacggtccgtaccgtaccgttccgtaaggttccgaccgtaccggaacggtcccgttccggcccccgttcgggttacccaccggtttcccgttcccggttcccccgtaccccgttcccggttacggttaacggtaaccgttaccgaaccggtttcggaccgggtcccggg

SEQ ID NO: 261961 - DNA, 718 bp, Homo sapiens
  misc_feature: GYAE6OF02FJSBA.16.46.E02.1.454.CMB.1.raw
  modified_base (269)..(269): a, c, t, g, unknown or other
  misc_feature (269)..(269): n is a, c, g, or t
  modified_base (317)..(317): a, c, t, g, unknown or other
  misc_feature (317)..(317): n is a, c, g, or t
tcagtgtactactccacgaccggtgctcgatttagactcatctacagggaaaggggctggtgcctgggctctgctcctcctcaccctcctcactcagggcacaggatcctgggctcagtctgccctgactcagcctccctccgtgtccgggtctcctggacagtcagtcaccatctcctgcactggaaccagccagtgacgttggtagttataaccgtgtctcctggtaccagcagccccaggcacacgcccccaaactcatgatttangaagtcagtaatccggccctcgaggggtccctgacttcgtcttttcgngggtaccaaggtccgtcgggaccaacgaccgggtccccttccccgtgacctatccttcgtcggggcctcccgagggcctggacgggaccgagggcctagtactttaactttaccgtgaccgaggtccttacgaattaagtaacggaaaggttcgggacctaaggtcctaacttccgtacggtttaacggtttccggggtcggggttagggaaccctaaaggtcccgtacggtacccggttccgttaacggggttccgaaccgggtacccccggaaagggcccgttacccgggacccccccgtttcgggtacccctaccgtttcccgtcccggtttacccccctaccccgttccgtaccggtacggttaccgtaccgtccgttacggacggtccgggtcccg

SEQ ID NO: 261962 - DNA, 565 bp, Homo sapiens
  misc_feature: GYAE6OF02HKSMI.16.46.E02.1.454.CMB.1.raw
  modified_base (387)..(387): a, c, t, g, unknown or other
  misc_feature (387)..(387): n is a, c, g, or t
  modified_base (553)..(553): a, c, t, g, unknown or other
  misc_feature (553)..(553): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcacacgccccaaatcatgatttatgaagtcagtaatcggccctgacggggtccctgatcgcttctctggtccaagtctggcaacaccggcctcctgaccatctcgtgggcctccgaggctggaggacgaggctgatttacttacngcagtcttaatatacgaggacaaactaattacttttgtcgtttacggaacttgggaacctaaggtccaaccgtcctaggtccacgacccaaggcccaaacccgatcgtacctactccgtcgttccccgccctccttacgaacgttactacacttggacgccgggtntcgggacaacgg

SEQ ID NO: 261963 - DNA, 527 bp, Homo sapiens
  misc_feature: GYAE6OF02G05YX.16.46.E02.1.454.CMB.1.raw
  modified_base (472)..(472): a, c, t, g, unknown or other
  misc_feature (472)..(472): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatccggccctcgaggggtccctgatcgcttctctgggtccaagtctggcaacacggcctccctgaccatctctggctccaggctggaggacgaggctagatttatactgcagtcttaatactacaggcaaactaattacttttgcttcggaactgggaccaaggtcaccgtctagtcagcccaagcccaacccntcgtcactctcgttcccgccctctcgagtactacacgtgacgcggctggacacgg

SEQ ID NO: 261964 - DNA, 593 bp, Homo sapiens
  misc_feature: GYAE6OF02FE68E.16.46.E02.1.454.CMB.1.raw
  modified_base (524)..(524): a, c, t, g, unknown or other
  misc_feature (524)..(524): n is a, c, g, or t
tcagtgtactactccacgaccggtgctcgatttagactcatctacagggaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagccacgccccaggcaccacgacccccaaatcatgtatttatgaagtcagtaactccggcccttcgagggtccctgactcgcttctcgtcgggtccaagtcctggcaaccgaccggtcctcctagacctagtctcgtcgggccttaccgaggtcctaggacgggaccgtaggtcctaggtatttacgtacgtgcgtagtcttaatagtacaggtactaactattacttttgtcgttacggacgttacggactacggtccaccgttctaggtaccacgtacccaacgtcccaacccntcgtaccacttctcgtaccctaccctccgtacgtacgtacgtacgacgtggacgcggtctggactacgg

SEQ ID NO: 261965 - DNA, 543 bp, Homo sapiens
  misc_feature: GYAE6OF02IA62S.16.46.E02.1.454.CMB.1.raw
  modified_base (471)..(471): a, c, t, g, unknown or other
  misc_feature (471)..(471): n is a, c, g, or t
tcagtgtactactccacgaccggtgctcgatttagactcatctacagggaaagggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaaactcatgatttatgaagtcagtaatcggccctcaggggtccctgatcgcttctctgggtccaagtctggcaacgacggcctccctgaccatctctgggcctccgagctgaggacgaggctgatttatactgcagtcttatatacaggcaaactaattacttttgtcttcgaactgggaccaggtccaccgtctaggcacgccaagcccaacccnctgtccactctcgttcccgcccttacctcgacgttacgtaccacgtcggacgccgggctcggacgtaacggg

SEQ ID NO: 261966 - DNA, 534 bp, Homo sapiens
  misc_feature: GYAE6OF02F9S1I.16.46.E02.1.454.CMB.1.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (469)..(469): a, c, t, g, unknown or other
  misc_feature (469)..(469): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctactgcactggaaccagcagtgacgttggtagttataaccgtgtctcctggtaccagcagcccccaggcacagcccccaaatcatgatttangaagtcagtaatcggccctcaggggtccctgatcgcttcnctgggtccaagtctggcaacacggcctccctgaccatctctgggcctccgaggctggaggacgaggctgatttatactgcagtcttatatacaggacaacaattacttttgtcttcggaactgggaccaggtccaccgtctaggtcagcccaagcccaacccntgtcactctcgttccccgccctcctcgtagtacgtaccacgttggacggccggctggacaacggg

SEQ ID NO: 261967 - DNA, 575 bp, Homo sapiens
  misc_feature: GYAE6OF02GHA1D.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgatttatgaatcagtaatcggccctcgaggggtccctgactcgcttctctcgggtccaagtctggcaacacggcctcctgaccatctcgtgggcctcaggctgaggacgagctgtatttatactgcagtcttatatacgaggacaacgtaattcttttgtactttcggaacgttcgggaactaaggtccaccgttaccgtaggttcaccgacccgaaggaccccaaccccacgtcgtaccaccttcctcgttcccccgcccttcctacgacgttacgtaccacgttcggacggcgggtctacggacgtaacgg

SEQ ID NO: 261968 - DNA, 686 bp, Homo sapiens
  misc_feature: GYAE6OF02HPV2B.16.46.E02.1.454.CMB.1.raw
  modified_base (280)..(280): a, c, t, g, unknown or other
  misc_feature (280)..(280): n is a, c, g, or t
tcagtgtactactccacgaccggtgctcgatttagactcatctacaggggaaaggggctgtgcctgggctctgctcctcctcaccctcctcactcagggcacaggatcctgggctcagtcttgccctgactcagccctccctccgtgtcccgggtctcctggacagtcagtcaccatctccgtgcacgtggaaccagccaggtcgacgttggtagttataaccgtgtctcctggtaccagcacgcccccaggccacaccgaccccaaactcatgatttangaagtcagtaagtcggcctgacggggtccctgactcgcttctcgtggtaccaagtctcggacaaccgacggtccctcctacgacctatccgtacgtcgggcctccgaggtctaggagggtaacggacggtccgttagtaatttacgttacgtagactacggtcttaataacgtacgaacgtacctaaactaatttactttcgttaccgttacggaacgttcgggaacctacggtaccgtaccgttaccggttaggtaccgtacgtacccgaaccggtacccctaacccgtacttccgtacctaccgttaccgttcccggttcccccgtccccttccttaccgggaaccgtttactaacccgtacgtacggtaccggaccgggtccgtaggggtcccgtaaacgggg

SEQ ID NO: 261969 - DNA, 543 bp, Homo sapiens
  misc_feature: GYAE6OF02F54UN.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaatcatgatttatgaagtcagtaatcggccctcaggggtatctaatcgcttctctggctccaagtctggcaacacggcctccctgacccgtctctggcctccagactgagacgaggctgatttattactgaccactcatatagaagtagtactactcttgttggtttcggcggacggacaagctagaccgtcgtagtcacgcccaaggcctcggcccctcggtcctacgtcctcgttccccacccttcctaccgagttacgtacactgacgccgggcgtaggtaccgg

SEQ ID NO: 261970 - DNA, 547 bp, Homo sapiens
  misc_feature: GYAE6OF02FO9E4.16.46.E02.1.454.CMB.1.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
  modified_base (469)..(469): a, c, t, g, unknown or other
  misc_feature (469)..(469): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaatcatgatttangaagtcagtaatcggccctcgaggggtccctgatcgcttcnctgggtccaagtcnggcaacacggccctcctgacccatctcgtgggctccaggctggaggacgaggctgactttattactgcagtcttatatacagcaactatacttttgacttgactgggaccaggtccacgtctagtcacgacccaagcccaaacccnctcgtacctacttcctcgttccccacccttcctaccgtctaacgtaccacgtcggacggcgggactggacctaacggg

SEQ ID NO: 261971 - DNA, 559 bp, Homo sapiens
  misc_feature: GYAE6OF02F1VIH.16.46.E02.1.454.CMB.1.raw
  modified_base (374)..(374): a, c, t, g, unknown or other
  misc_feature (374)..(374): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggccctcgaggggtccctgatcgcttctctgggtccaagtctggcaacgaccggcctccctgacccatctcgtgggcctcgaggctggaggacgnggctgtatttatactgcagtcttatatacgaggacaaactaattacttttgtcttacggaacgtcgggaacctaagtccaccgttcctaggtccacgacccaaggacccaacccgctcgtccacttcctccgttccccgccctcctcgacgttacgtacacgtggacggcggcgtggactaacgg

SEQ ID NO: 261972 - DNA, 583 bp, Homo sapiens
  misc_feature: GYAE6OF02JENZK.16.46.E02.1.454.CMB.1.raw
  modified_base (268)..(268): a, c, t, g, unknown or other
  misc_feature (268)..(268): n is a, c, g, or t
  modified_base (339)..(339): a, c, t, g, unknown or other
  misc_feature (339)..(339): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaaactcatgatttangaaagtcaagtaatcggaccctcgaggggttccctggaatccgctttctctcgggtccaagtctggcaacncggccctccctgaccatctctgggctccgagctgaggacgagctgatttatacgtgcagtcttaatatacaggacaacgtaattacttttgtctttacggaacttgggaacctaaggtcctaccgtcgtaggtaccacgtcccgaacggacccaacccgacttcgccacttcctacggttccccgtcccgttcctcggtaacgtacgtaacctacgtcggacgccgggtcgtcggactaacggg

SEQ ID NO: 261973 - DNA, 563 bp, Homo sapiens
  misc_feature: GYAE6OF02HAPOT.16.46.E02.1.454.CMB.1.raw
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgatttangaatcagtaatccggccctcgacggggtccctgatcgcttctcgtgggtccaagtctggcaacacggcctcctgaccatcgtctgggcctcgagctggaggacgagctgtatttattacngcagtcttatatacagactaactattactttgtacttacggactcgggaccaggtcaccgtcgtacgtaccacgacccaacgaccctaacccgctacgtccacgttcctccgtttccccgcccttcctcgtaacgttacgtaccacgtcgacggccggtcgtcggacgtaacgg

SEQ ID NO: 261974 - DNA, 530 bp, Homo sapiens
  misc_feature: GYAE6OF02IYK6A.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaatcatgatttatgaagtcagtaatcggccctcaggggtccctgatcgcttctctgggtccaagtctggcaacacggcctccctgaccatctctcgggctccgaggctgaggacgaggctggatttattactgcagtcttatatacaggcaacaattacttttgcttcgaactggaccaaggtccacgtcctaggtcacgcccaaggcccaacccactgtcactctcgttcccgcctcctcgagtacgtaccacgtcggacgcgggtctggcaacgg

SEQ ID NO: 261975 - DNA, 624 bp, Homo sapiens
  misc_feature: GYAE6OF02G17H5.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataccgtgtctcctggtaccagcacgccccaggcacacgccccaaactcatgtatttatagaagtcagtaactccggccctcgacggggtccctgactccgtcttctcgtgggtccaaggtctggaccaacgaccggtccctcccgtcgaccctactcctcgtcgggcctccgacggctggaggacgaggctagtatttagtacgtgctagtactttatagtaacgagactaaactaactttacgttttgttccgttacggaacgtacgggaacctaacggtccgtaccgtacgtacggtacacgacccgaacgacccaacccgtctacgtcctaccttccgtaccgttccccacccttcctacgtacgttaaccgtaccgacgtacggaccggtccgggtcgtacggacgaacgg

SEQ ID NO: 261976 - DNA, 595 bp, Homo sapiens
  misc_feature: GYAE6OF02F5V7X.16.46.E02.1.454.CMB.1.raw
  modified_base (341)..(341): a, c, t, g, unknown or other
  misc_feature (341)..(341): n is a, c, g, or t
  modified_base (511)..(511): a, c, t, g, unknown or other
  misc_feature (511)..(511): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatcctcctgcactggaaccagcagtgacgttggtagttataaccgtgtctcctggtaccagcacgcccccaggcacacgcccccaaatcatgatttatagaagtcaagtaagtccggcccctcgacggggtccctggactcgtcttctcgtgggtccaagtctggcaacncggccctcctgaccatctcgtcggctccgaggctggaggacgagctagtatttatacgtgcagtcttatagtacaggactaaactaattacttttgtaccgttacggtaactacgggaaccaaggttcctaccgttccgtacggtaccacgacccaacgacccaaccccnctcgtacctaccttacgtcgttcccccgcccgttcctacggtacgtaccgtactacgtggaccggtcgggactcggacgtacgg

SEQ ID NO: 261977 - DNA, 691 bp, Homo sapiens
  misc_feature: GYAE6OF02GNAQF.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtttgccctgactcagcctccctccgtgtccgggtctcctggacagtcagtcaccatctcctgcactggaaccagcagtgacgttggtagttataaccgtgtctcctggtaccagcacgcccccaggcacacgacccccaaactcatgtactttatagaagtcagtaactccggccctcgacggggtccctgactcgtacttcgtcgtcgggtccaagttctggaccaacgccggtccctacccgtcgaaccctattcctcgtcgggtcctaccgaggtctaggacgggacgtaggtcttaggtactttaacgttacgtcgactacgtctttaatactaacgaacggtactaaacttaacttttacgttttacgttaccgtttacgggaaacgttcgggaaacccttaacgggtcctaacccggttccgttaacgggtaccaccggtaccccgaacgggaccccctaaacccgtacgtccgtaacctacccgtccttaccgttcccccaaccgttccgtacggtaacgtacgtaccgtacgtggaccggtccggtacgtcggaccgaggtacccg

SEQ ID NO: 261978 - DNA, 636 bp, Homo sapiens
  misc_feature: GYAE6OF02HC9TR.16.46.E02.1.454.CMB.1.raw
  modified_base (269)..(269): a, c, t, g, unknown or other
  misc_feature (269)..(269): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccggtctcctggacagtcagtcaccatctcctgcactggaaccagcagtgacgttggtagttataaccgtgtctcctggtaccagccacgcccccaggcacacgccccaaactcatgtatttangaatcagtaactcggcctcgagggtccctgactcgcttctcgtggtccaagtcnggacaacgccgcctcccngaccatcctcgtgggcctccgaggctaggacgacgaggctagtatttactactgactacgtacttaatactacgaacgtacaaacgtaactttacgttttacgtaccgtttaccggaaacgttacgggaaaccctaagggtaccctaaccggttaccgtaacggtaccaccgtacccggaaccgacccctaaacccgccttacgtacctaccgtccttacccgtaccccaccccgttcctaccggagttaaccgtaccgtaccgtacggaccggtcgggacgtcggaccaacggg

SEQ ID NO: 261979 - DNA, 887 bp, Homo sapiens
  misc_feature: GYAE6OF02JLR7O.16.46.E02.1.454.CMB.1.raw
  modified_base (139)..(139): a, c, t, g, unknown or other
  misc_feature (139)..(139): n is a, c, g, or t
tcagtgtactactccacgaccggtgctcgatttagactcatctacagggaaaggggcgtgtgcctgggctctgctcctcctcaccctcctcactcagggcacgagactccgtgggctcgacgtctcgccgtcgtactcncgccctcccgtccgtcggtccgggtcctccgtacggactacgtcgacgtccacctatcctccgtcgctacgtacggaaccacgctaggtggtacggtttgggttaacgttaacgttaaccggttgtccttccgttacggtaacccacgaccgacccgcccccggacggaccaaccgaaccccggaacccccctaaaatccaagttacgttaatttacgtaacgtaaacgttcgaaacggttaaccgttcccggtaccccgttacggaaccggggttccctaggtaccgttccgttccctttcggttcggttaccggtaccgttaacggttcgtaccgggaacccaaccggtacccggtccccgttaaccccggtctaaacctcgtttaccgtccgggtttacgggccttaaccggcggtaccgtagggaaccggggtacgtcggtacgttagtaaagttttaccttaccgtcggtacgtaacctttacgtttaaacgttactaacggacggtaaactaaacgtttaacgttttccgttttacggttaacggtttaccggaaccggttacgggaaccgtaccggtccgtaaccggtcgttaaccggtaccgaccgtaaccccggaacgtaccccctaaccgtctacgttacccttaccttccgtaccggttaacccccctccgttaccggtacgtaaccggttacctaaccgtacgtacggccggtcgggtaccggtcggaggtaccgg

SEQ ID NO: 261980 - DNA, 639 bp, Homo sapiens
  misc_feature: GYAE6OF02GSW8W.16.46.E02.1.454.CMB.1.raw
  modified_base (268)..(268): a, c, t, g, unknown or other
  misc_feature (268)..(268): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgccccaaatcatgtatttangaagtcaagtaactccggccctcgacggggtccctgactcgtcttctcgtcgggtaccaagtctggaccaacgccggtccctcccgtagacctactccgtcgtcgggcctccgaggtcgtggacggacgaggtctagtactttagtacgtgactagtcttaatactacgacgactaaactaactttacttttgtacgttacggaacgtacggaacctaacggtccaccgttcgtacggtccacgacccgaacggacccctaaaccccgtcgttacgtaccctaccgttccttacccgttacccccgtacccgttccgtacggtaacgttaaccgtaccgacgttcggaccggtccggtcgcggagaaccgg

SEQ ID NO: 261981 - DNA, 855 bp, Homo sapiens
  misc_feature: GYAE6OF02FI70B.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttataccgtgtctcctggtaccagcacgccccaggcacacgccccaaactcatagtatttataggaagtcaagtaacgtccggccctacggtacggggtccctagacttcgccgtttctcgtacgggtacctaaggttccgtaggaccaaccgtaccgggtccccttacccgtacggaaccctagttccgtacggtcgggtccctccggaagggtcgttacgggaacgggtaccggtacggtcgttagttaactttttacgtacgttacggtaccaacggttaccttttaaagtaaacgttaaccgtaaaccgggtaccttaaaaccgttaaaacgttttttaccgttttttaccggttaccgttttaaacccggggttaaaccggttaccgggggaaacccgtttaaaaccgggttcccgttaaaccccggtttacccggttaacgggtacccctaaacccgggtaaccccggtaaacccggtaaccccctaaaccccggtaccgttacgtaaccctacccggtttccgttaccccggttaccccccgttccccgtacccgttaaccggttaacgtttaacccggtaacctaaccgggttcgggtaaaccccgggtgggttaccccgtacgggaaccgtaacccggg

SEQ ID NO: 261982 - DNA, 803 bp, Homo sapiens
  misc_feature: GYAE6OF02GYEX7.16.46.E02.1.454.CMB.1.raw
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtcgtccgggtctccgtggacagtcagtcaccatcctcctgcacgtacggaaccagcagtgtacggtttaggttaagttaacgtaaccgtgtcctccgtggtaccagccaccgcccccgaaggaccaccgaccgaccccaaactcatagtattanagaagtctaagtacgtccggcctacggacgggttcccngacttcgtcttcgtcggtacggtacctagtcgtcggaaccaaccggtacccggtccctacccgtacgtaacctacgttccgttacggtacgggacccttaccggagggtacccgttaggggaacggaacgtacggtcgttaagtttaactttaacgtttaacgtcgtaacgttaacgttaaccgtttaaactaaacgttaccgaaacggtaaaccttaaaacgtttaacgttttaccgttttaacggttaccggtttaacggtaaaccggttaaccgggtaaccgtaaacggtcccgtaaccgggttccgtaacgggttaccgacccgtaaacccgaaacccgaaccccctaaacccgttaccgttaccgttacctaccgttaccgttcccgtaacccccgttaccgtaccgttacgtaacgttacccgtactacggtccggacggtaccggcgtaccggacggtacg

SEQ ID NO: 261983 - DNA, 790 bp, Homo sapiens
  misc_feature: GYAE6OF02JY1CK.16.46.E02.1.454.CMB.1.raw
  modified_base (318)..(318): a, c, t, g, unknown or other
  misc_feature (318)..(318): n is a, c, g, or t
  modified_base (440)..(440): a, c, t, g, unknown or other
  misc_feature (440)..(440): n is a, c, g, or t
tcagtgtactactccacgaccggtgctcgatttagactcatctacagggaaaggggctgtgcctgggctctgctcctcctcaccctcctcactcagggcacaggatccgtgggctcagtctcgccctgactcagcccttccctccgtggtccgggtctccgtggacagtccagtccacctatcctcctgccaacgtacggaaccagctagtaggtacggtttaggttaacgttaactaaccgttgtccttaccgttcggaaccagccaccgccccgaggaccacgacccgtacccccaaatccaagttagtagtttanacgtaacgtcgtaagtaacgtcccggtacccgtacggtacggtccctagtaccttcggtcctttccgtcggttacggtctaacgttccggaggaccaaccggtccgtccctaccgtataccncgttcgtcgtcggacctacggacggtcgtaaggacggtacgacggttctaacgttatttaacgtacgtacgtacgtagtttacctagttaaacgaccgtacgtaaactaacgtttacgttttacgtacggttaaccgttagggaaccgttaacgggacctaaaccgggttccctaaacgttccggtacggtacccgacccgaacccgtaaccgacccctttaaacgccgtttacgaaccccgttttccgtaccgttcccccggtttacccgtacccgtaaccggtttcgttaacgttaaccaccggttacggacgggttaccggacggtttccggacgtacggtaaccgg

SEQ ID NO: 261984 - DNA, 736 bp, Homo sapiens
  misc_feature: GYAE6OF02F028G.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggccacacgacccccaaactcatgatttatgaggtcagtaactcggccctacgtaggggtttctaagtcgtcttctcgtcggtacctaccgtaagtcctacgggacctaaaccgaccgggtcccttccccgtagacccgtattccgtacggtcggggtcctacccgagggtaccgtgggaacgggtacgggtaaggggttcgtaagttttaacgttaccgtacggaccgtacggtcctaactaagttaacgtaaagggtaaacggtcggaccgacgtaccctaacgttccggttaccggtttacggttaccgggtaccgggtacgggacccgtaaggtccgtacggaccccgtttacgtacggtaccgaccgtaccgtacggtccgtcccgtcccccgtacggtcctacccgttccgttacccgtttcccctaccccgttaccgttacccgacgttaaccgtaccgtacggtaccggtacgggtcccgggtacgg

SEQ ID NO: 261985 - DNA, 690 bp, Homo sapiens
  misc_feature: GYAE6OF02FRWVQ.16.46.E02.1.454.CMB.1.raw
  modified_base (270)..(270): a, c, t, g, unknown or other
  misc_feature (270)..(270): n is a, c, g, or t
  modified_base (355)..(355): a, c, t, g, unknown or other
  misc_feature (355)..(355): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggcaccacgacccccaaatccatgatttangaagtcagtaagtccggccctcgacggggtccctgacgtccgcttccgtcgtcggtaccaagttcaggcaacgccggccctccgngacctatccgtcgcggtcctaccaggtcgtaggacgggacgaggtactagttaactttacttacgtcgacacgttactttaatacgtaacgaacggtactaaacttaacgttacgttttgttacgttaacgggtaacgttaccgggaaccgttaacggttcccgtaaccgttaccgtagggtcccgaacgtaccccggtaacgcccctaaaccccgtagtcccgttacgtacccttaccgttacccgttacccccgaacccgttaccgtacgttaaccgttaactaacccgtacgtcggaaccgggtccgggttaccgtcgggaaccgtaccggg

SEQ ID NO: 261986 - DNA, 838 bp, Homo sapiens
  misc_feature: GYAE6OF02HWE7M.16.46.E02.1.454.CMB.1.raw
tcagtgtactactccacgaccggtgctcgattttagactcatctacagggaaaggggctgtgcctgggctctgctcctcctcaccctcctcactcagggcacaggatcctgggctcagtctgccctgactcagcctccctccgtgtccgggtctcctggacagtcagtcaccatcctcctgcactggaaccagcagtgacgttggtagttactaaccgtgtctccgtaggtaccagcacgcccccgaggccacaccgaccccaaatcattgtaatttagagtaagtctaagttaacgtcccggtccctacggtacggggttccctagtaacttccggtctttaccgttccggttacgggtaccctaaggttccgtacggacccaaacgcccggtccccttaccctacgaaccctacgttccgttccggtcgggccctaccggtacggtcgttacggaacgggtaacgacggttacgttaggtaacttttacgttaacgtcggtactacgtacttaagtaacgtacgacgtaactaacttaaacgtttcttttaggttaccgttacgggtaaccgttacgggtaaaccctacggttacccgtaccgttacccggtacggttaacccaaccggttaccccgaaaccggtacccccttaaacccggtacgttccgttaacccgtaccccgttttcccgttacccggtttccccccccgtaaccgttttacccccggtaaacggttaaaccggtttaacccggttaacccgtaccggtttacccggggaaaccgggttcccccgggggttaaccgtaccgggggtaaacccgtaaccggggg

SEQ ID NO: 261987 - DNA, 735 bp, Homo sapiens
  misc_feature: GYAE6OF02HOI3C.16.46.E02.1.454.CMB.1.raw
  modified_base (433)..(433): a, c, t, g, unknown or other
  misc_feature (433)..(433): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgtacgttggtagttataaccgtgtctcctggtaccagcacgcccccaggccacacgacccccaaaactcaattgtatttatagaagtcaagttaactccggcccttaggacgggtccctggactcgtacttcgtcgtcggtacctagtctggacaaaccgccggtccctcccgtacgacctactcgtcgtcggcctccgaggtctggacggacggaggcttagtaatttacttacgngtacgtacgttatttaactactacgtaaggaacctaaacttaacgttttaccgttttacggttaccgtttacgggaaccggtttacgggaacccgtaacgggttacccgaacccggtttaccggtaacgggttacccgaaccggtaaccccggtaaaccggtacccccgtaaaccccgtacgtccgttaccctacctttcccggttacccgtttccccccggtaccccttccggtaacggtaacgttaaccggtaacctaccggtacggaccggtccggggtacctccgggacggtaacggg

SEQ ID NO: 261988 - DNA, 674 bp, Homo sapiens
  misc_feature: GYAE6OF02HEYZY.16.46.E02.1.454.CMB.1.raw
  modified_base (292)..(292): a, c, t, g, unknown or other
  misc_feature (292)..(292): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcacgcctccctccgtcggtccgggtctccgtggacagtcagtccaccatcctcctgcactacggaaccagctagtgtacggttggtacgttactaccgtgttcctccgtcggtaccagccgaccgccccgaggccaaccaccgaccccaaatcatagtattanagaactcaagtacgtccggcctacggacgggtccctgacgtcgtcttccgtcggtcggtaccgagtcgtacggaccaaccgccgtcccctacctacgtaccacgttcgtcgtcggtcctacgacggtcgtagggacggtacggacgtacgtagtactttaacgttcgtacgcgtaagtacgttaaactacgtaacaggtaaccttaaacgttaactttacgtttcggtaaccttacggtacgtaccgggtaactcggaccctacggtcgtacggcccacgccgtaaccgcccaacccgtcgtactaccaccttccgtaccctcccgaccttcggaactacgtaacgtcgaccgtacggccggaccggtcggacgacggtacg

SEQ ID NO: 261989 - DNA, 667 bp, Homo sapiens
  misc_feature: GYAE6OF02IBEWK.16.46.E02.1.454.CMB.1.raw
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
tcagtgtactactccacgaccggtgctcgatttagactcatctacagggaaagggggtgtgcctgggctctgctcctcctcaccctcctcactcagggcacaggatcctgggctcagtctgccctgactcagcctccctccgtgtccgggtctcctggacagtcgatcatcatcttctgcactggatccagcagtgacgttggtagttataattatgtctctgtacaacacgtaccaggacaaacgccccaaacncatgtattangagtcagtaacgtcgcctgtagggttntaacgtcgtcttctcgtcgctccaagtcgtgaccgaacgaccgtccctcctgacctatcgtcgtcgggctaccgaggtctaggacggtacggtaggggttntacgtttaacttacgtgacgtacgtcttacgtaataagtaaggtaacggtcggacacgctaccgttcgttacgttacggttccgggcgggtacggaacctaaggtccgtacggtacccgtacgtacggtaccgaaccggtacccgaaggtccccgtacccggtcccccgtaccgggttaccctacccgttccgttcccgttaccccctaccccgtttaccgtaccggtaacggttaccgtaaccgtaccggtacggtaccgggaccgggtacgg

SEQ ID NO: 261990 - DNA, 774 bp, Homo sapiens
  misc_feature: GYAE6OF02INFS1.16.46.E02.1.454.CMB.1.raw
  modified_base (287)..(287): a, c, t, g, unknown or other
  misc_feature (287)..(287): n is a, c, g, or t
tcagtgtactactccacgaccggtgctcgatttagactcatctacagggaaagggggctgtgcctgggctctgctcctcctcaccctcctcactcagggcacaggatccgtgggctcagtctgccctgactcagccctccctccgtggtccggtctcctggacagtcagtcaccatctcctgacactaggaaccagcagtgtacgttggtagttaataaccgtgtactccgtacggtaccagacgaccgtccccaggccacaccgaccccaaatcatagtaatttanagaatacaagtaacgtccggaccctacggtacggggtccctaggacgttaccgtcttcgtacggtacggtacctaaggttccgtggtaaccaacgtacccggtacccttaccgtacgaacctacgttaccgtacgttcgggaccttacggaggtcgtaggaacggtaacgagtacttacggtaatttacgtagtacggactaaggttacttaagtaacgtaacggtaagtaaaccttaaacgttaacttttaaccggtttttcggtaaccgtttaacgggtaaacggtacggtaaaccgtaacggtacccctaaccggttccggtaaaggtacccaaccgaaccccggtaaccgaccccgtaaacctagttaccgtaccctaaccgttacccgttaacccgtccccccgtaaaccgttacccgtaaggttaaccgtaaccgtagtaccgtacgggtaccgccggggttaacctcggaacgtaccggg

SEQ ID NO: 261991 - DNA, 616 bp, Homo sapiens
  misc_feature: GYAE6OF02IHCIN.16.46.E02.1.454.CMB.1.raw
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (568)..(568): a, c, t, g, unknown or other
  misc_feature (568)..(568): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtcctctggtaccagccacgcccccgaggcaccacgacccccaaactcatgatttatcgagtacagtaatccggacctcgcggggtccctgacgtcgtcttctcgtggtaccaagtcgtcgctaacgccgcctcctagaccattcncgtacggcctacgngtcgngaacgggacgtagctagatttacttacgtgtaccagtcttaatactacgaagtacaaacgtaactttcgtttacttacgttacggtacgtacgggacctaacgttccgtaccgttacgtacgtcgacacccgtaccgaacccgaacccacgtcgtccgtacctcgtaccgttacccgccttcccctntaacgttacgacctcgtacggacggccgggtacgtacggacgtaacgg

SEQ ID NO: 261992 - DNA, 681 bp, Homo sapiens
  misc_feature: GYAE6OF02HPTHZ.16.46.E02.1.454.CMB.1.raw
tcagtgtactactccacgaccggtgctcgatttagactcatctacagggaaagggctgtgcctgggctctgctcctcctcaccctcctcactcaggcacaggatccgtggctcagtctgccctgactcagcctccctccgtgtccggtctccgtggacagtcagtccaccatcctcctgcacgtcggaaccagccagtgacgttggtattataaccgttgtcctccgtaggtaccagccaccgccccaggaccacaccgacccccaaatcaatcgtatttagagtaaacgtcaagtacgtccggaccctacggacgggtccctagactcgttactcgtcgtacggtaccacgtcgtacggacaacgcccggtccctaccgtacgacctacttcccgtacgtcggtccacggtacggtacgtacggaacggaaccggttacgtacttaggtaacttttacgtaccgtggacctacgtctacgtaagtacgttaaggtaacgtcggaacctacgaccgttactacgttacgttacggtcgggacggtacgaccgtacgcgtacgacccgtacgtacgtcgaaccgcgaacgtccctcccggacccgttcgtacgtcccgtcccgttccttaccccgtacctacgtacggttaccgacgttaccgtaacgttggaccgtccggg

SEQ ID NO: 261993 - DNA, 567 bp, Homo sapiens
  misc_feature: GYAE6OF02HMSQC.16.46.E02.1.454.CMB.1.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
tcagtgtactactccacgaccggtgctcgattttagactcatctacagggaaaggggctgtgcctgggctcttgctcctcctcaccctcctcactcagggcacaggatcctggctcagtctgccctgactcagcctccctccgtgtccggtctcctggacagtcagtcacccatctcctgcactggaccagcagtgacgttgtagttanaacgtgtctcctggtaccagcagcccccaggcacagcccccaaatcatgatttangaatcagtaatcggccctcaggggtccctgactcgcttcnctggtccagtctgcaacgacggcctccngaccatctctgggctcacggctgacggcgaggctgaattctacgtncagtcttatactagacgctaaacaattacttttggtctttacggacttagggaccaagtcaccgtccgtagtccgagtaccaacgccctaaaccctcgtcgtcctaaccgtccttacgtttcccccgcccgtacccgttcgtaagttaccgaaccttcgtaggaccgcgggtacgtcgtacgtaaccgg

SEQ ID NO: 261994 - DNA, 955 bp, Homo sapiens
  misc_feature: GYAE6OF02FSIJI.16.46.E02.1.454.CMB.1.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (459)..(459): a, c, t, g, unknown or other
  misc_feature (459)..(459): n is a, c, g, or t
tcagtgtactactccacgaccggtgctcgattagactcatctacagggaaggggctgtgcctgggctctgctcctcctcaccctcctcactcagggcacaggatcctggctcagtctgccctgactcagcctccctcgtgtcccggtctcctggacacgtcagtccaccattccgcctgccacgtaggaaacccaggtccaggtcgtaccggtttggttaacgttactaccggtcgtctccttggaccccncgcaccgtcccccgaggtccaccgccgacccccctaattccaagtntactttagcgtaacgtaccaaggttacccggtccggtccccgtacggtactttccccgtaggtccttccgtcgttttacgacggtttccggggtaaccctaacggtccgtacgggaaccgtaaccccgtcccgggtaccccttaccccgtacggtaaccccncggtttccgtacccggttcccgggtccccttaaccggacggttaccgggtacggtaacggggtaacccggtaccggttaccctacggtttaaacctttaaccgttaccgttacgggtccccaagtttacccgttaacgtaacccgaaccggtaacgtaaccccttaaaccgtttaaccggtttaaaccttttaccgggtacccgtttaaccgggtaaccgtacccggggttaaccgttaaccggggtaccccttaacccgggttacccggtaaaccggttacccgaacccccgggttaaacccccgaaaaaccgggtttcccccccaaaaacccttaggtttccccgtaacccgttaacccgttccccgttttaaccccgggtcccccgtaaccccgtttacccggaaacccggtttttagaaaccccggttaacccggtttcggaacccggttcgggggtccccgtaacccgggtaggtaccccggtaacccggg

SEQ ID NO: 261995 - DNA, 690 bp, Homo sapiens
  misc_feature: GYAE6OF02JB49T.16.46.E02.1.454.CMB.1.raw
  modified_base (219)..(219): a, c, t, g, unknown or other
  misc_feature (219)..(219): n is a, c, g, or t
  modified_base (364)..(364): a, c, t, g, unknown or other
  misc_feature (364)..(364): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcacgtggaaccagcagtgacggttggtagttataaccgtntctctggtaccagcacgccccagcaccacgcccccaaatcatgtatttacagtaagtcaagtaactcggccctcgaacggggtccctgatcgtccttcgttcgtcgggtactagtcgtcggaccacgccggccctccgtgacctntccgtcgtcggcctccgaggcctaggaggaccgacggtctaggtacttttaactacgtgacgtacgttcttaataacgtaactacggtacctaaacgtaactttacgttttacgttacgtttaccgtacggtaccgggtaacgtacggttaaccgtaccgttaccgtaccgtacccgaccggtaacccgaaccggacccctaaacccgtaccttaccgtccgtaaccctccgttcccgttcccccggtcccgttacccgttaccggtaacgttaccgtaaccgtacgtaccggtaccggccgggtacgtaccggtacggaaccggg

SEQ ID NO: 261996 - DNA, 674 bp, Homo sapiens
  misc_feature: GYAE6OF02FM49E.16.46.E02.1.454.CMB.1.raw
  modified_base (318)..(318): a, c, t, g, unknown or other
  misc_feature (318)..(318): n is a, c, g, or t
tcagtgtactactccacgaccggtgctcgatttagactcatctacagggaaagggggctgtgcctgggctctgctcctcctcaccctcctcactcagggcacaggatcctgggctcagtctgccctgactcagccctccctccgtgtccgggtctcctggacagtcagtcaccatctcctgcactggaaccagcagtgacgttggtagttataaccgtgtctcctggtaccagcacgcccccaggccacacgacccccaaactcatgatttatagaagtcaagtaatccggcccctacgacggggtccctagacgtcncttctcgtcgggtaccaaggtctgacaacgaccggtccctccgtcgacctagtcctacggcggtactaccgaggtcgtaggacgggaacggtacggtccgtaggtaactttaacgtttaccgcgtaccgtaagtacctttaagtacgttaacgaacggtactaaaccgtaactttacgtttcgttacgtacgtacggtacggtaacgtacgtacctacgtctacggtactaccgaccgtaaccggacccaaaccccgtagtccgtactaccgttccgtacccgtacccgtcccgtaccgtacgtaaccgttaccgtaactaccggtcggaccgggtcggtacgtaggaccgtacgg

SEQ ID NO: 261997 - DNA, 678 bp, Homo sapiens
  misc_feature: GYAE6OF02JJX9E.16.46.E02.1.454.CMB.1.raw
  modified_base (169)..(169): a, c, t, g, unknown or other
  misc_feature (169)..(169): n is a, c, g, or t
  modified_base (196)..(196): a, c, t, g, unknown or other
  misc_feature (196)..(196): n is a, c, g, or t
  modified_base (582)..(582): a, c, t, g, unknown or other
  misc_feature (582)..(582): n is a, c, g, or t
tcagtgtactactccacgaccggtgctcgatttagactcatctacagggaaaggggctgtgcctgggctctgctcctcctcaccctctcactcagggcacaggatccgtgggcctcagtctgccctgactcacgccctcccctaccggtcgtccgggtctccgtggacngtcagtcaccatctctgcactggaccngcagtcgcgttaggtattactacgtgtcctcgtacggtaccagcaccgccccgaggaccaacgaccgaccccctaaactcgatacgtattagtggaatacgtaacgtacgtccggacctacggccggttcctgactcgtcttctcggtacggccgtaaggtcgtcggacaacgtcccggtacctaccgtagacctactcgtcggtacggccttacggacggtacgtagggacggacggtacgtcggttataacgttttacgtacgtcgactacgttacttataacgacgacgtactaaagtactttcgttacgtctaaggtacgtacgggaactacggtccgtacctacggttacgtaccacgacccgaccgtaccctaacccgtntaccgtaccctcttccgtacccgtcccttcccgtacgtaaggtaccgttaccgtacctacggtcggggaccgttacgggcggtaccgacgtaccgg

SEQ ID NO: 261998 - DNA, 690 bp, Homo sapiens
  misc_feature: GYAE6OF02GICTI.16.46.E02.1.454.CMB.1.raw
  modified_base (275)..(275): a, c, t, g, unknown or other
  misc_feature (275)..(275): n is a, c, g, or t
tcagtgtactactccacgaccggtgctcgatttagactcatctacagggaaaggggctgtgcctgggctctgctcctcctcaccctcctcactcagggcacaggatcctgggctcagtctgcctgactcagcctcctccgtgtccggtctctggacagtcagtctaccatctcctgcactgaacagcagtgacgttaggtagtataaccgtgttctaccgtcggtaccagccacgccccaggacaacgacgtaccccaaatccatacgtatttanaggtactaccgaagttaacgttccgacctacgacggggttcccaaggtactcgtacttcctcgttcgggaccttaacgtctcggaaccgtaacgtaaccggcccttaccgtacgtacccgtaactcgtacggtcggaccgtcgtacgcgttaggacgttacggacgtactaggtacttacgtcgtacgtacgattacttaagtcgtaactaggtaacaactaacgttacccgttttaagtaccgtttacggaaccgttacgggaaaccctaggtaccgtaccggttaacgacgttacgaccgaccgtaacccgaacctaaccacgttaccacgtaccttacgtccgtacccgccttaccgtacgtacgttaacgtcctaacgttccggaccgttaccggtcgtcggtacgaacgg

SEQ ID NO: 261999 - DNA, 667 bp, Homo sapiens
  misc_feature: GYAE6OF02IHAOF.16.46.E02.1.454.CMB.1.raw
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (473)..(473): a, c, t, g, unknown or other
  misc_feature (473)..(473): n is a, c, g, or t
tcagtgtactactccacgaccggtgctcgatttagactcatctacagggaaaggggctgtgcctgggctctgctcctcctcaccctcctcactcagggcacaggatcctgggctcagtctgccctgactcagcctccctccgtcggtccgggtctcctggacagtcacgtcaccatcctcctgccacgtcggaaccagcagtgacgttggtagttaataaccgtgtcctccgtcggtaccagacaccgccccaggaccacgaccgacccccaaaatcatgtaatttacgngaagtcaagtaagtccggaccctgacgggtcccngactcgtcctttcacgttcgacctcgaacgtcgtacggaccaacgtacccgtcctacctacgacctactcgtcgtacggtacctacgaaggcctagggaacggtaacgggtagggtactaagtttacgttaccgagcctaaggccttanaagtagttaaacgacgtagcgactacgttaccgttacgtggttaacgtcgggtacggtggtaaccgaatcgtaaccggtcctacgtagtccaccggtaacccgtagccctaccgtccccgtaaggtcctaaaccgttcgtacccgtaccctaaccccgcgttagaaccgtcgaacggtcgtaccggacggtcgg

SEQ ID NO: 262000 - DNA, 738 bp, Homo sapiens
  misc_feature: GYAE6OF02FIQDA.16.46.E02.1.454.CMB.1.raw
tcagtgtactactccacgaccggtgctcgatttagactcatctacagggaaagggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgccccaggccacgacgacccccaaactcatgtatttatgaacgtacagtactccggcctcgacgggtccctgactcgtcttctcgtcgggtactagtccgtaggacaaccgaccggtccctccgtcgaacctacgttcgtacgtcgggacctaccggaggtcgtacggaacgggacgggtacgtcgttagttacgtttaactcgtacgactacggtactttaagtagtaaccgaacgtactaaacgtaacgtttcgtttttcgttaccggttaacggtacgttaccgggtaaccgtacggttaccctaccggttacctacgggtaccgtaaccggacccggtaaaccggacccctaaacccgttacgtccgttaccgttaacccgttcgttacccggttaccccctaaccccggtttaccgtacccgggtaagttaacccggttaaccgtaccggtaccggtaccgggttcccgggacggtttacccggaacggtaaccgggg

SEQ ID NO: 262001 - DNA, 730 bp, Homo sapiens
  misc_feature: GYAE6OF02FZ9LS.16.46.E02.1.454.CMB.1.raw
  modified_base (189)..(189): a, c, t, g, unknown or other
  misc_feature (189)..(189): n is a, c, g, or t
tcagtgtactactccacgaccggtgctcgatttagactcatctacagggaaaggggctgtgcctgggctctgctcctcctcaccctctcactcacgggcacaggatccgtgggctcagtctgcctgactcagcctccctccgtgtccggtctccgtgacagtcagtcacatctcctgcactgaacctancagtgacgttggtattataccgtgtctcgtacgtacagccacgcccctaggcaccgaccgaccccgaactctatcgttaatttacgagtaacgtcgtaaacgtacgtccgggtaccctacgggtaccggggtaccccttaggaccttccgtcgtttcgttacggttcgggacctaggccgcgtaccgaaccgtcccggtccttcccagtaccgtacgttccgtggtaccggccttaccgggacgtcggtacgaacgggacttcgggtctaggttaactttcgtactcgtactacgttacttacgtaacttacgaacgtactaacgtttaacttacgttttacggttacgtaacggtacggtaccggtaccgtacggtaaccgtacccgtaccggtaacgtaccggaccgtaccgtacgtcccgtaccgtacccggttcgtacccgtaccgttaccgttccgtaccccgtaccgtaccgttaaccggtacgtaccgtaacccgtacgtcggtaaccggtcggtacggttaccggaggtaccg

SEQ ID NO: 262002 - DNA, 789 bp, Homo sapiens
  misc_feature: GYAE6OF02HSZQS.16.46.E02.1.454.CMB.1.raw
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (711)..(711): a, c, t, g, unknown or other
  misc_feature (711)..(711): n is a, c, g, or t
  modified_base (777)..(777): a, c, t, g, unknown or other
  misc_feature (777)..(777): n is a, c, g, or t
tcagtgtactactccacgaccggtgctcgatttagactcatctacagggaaaggggctgtgcctgggctctgctcctcctcaccctcctcactcgacgggcacaggatcctgggctcagtctcgccctgactcacgccctcccgtccgtgttccgggtctccgtggacngtcagtcaccatctctgacagtcggaaccngctggtcgtacgttggtaattactaccgttctctcctacggaccngccaccgccccgagccacgaccaccccaaatcgtactagtaatttagaagtaactcgtaaacgttacgtccggcccgttaacggtaccgggttacctaggtaccgttccgttcctttccgtcggggttaccggttaaccacggtttcgtaccgggacctaaccggtcccggtacccttcccgtacggtaccttcgttcccgtacgggtcggtaccctacgggttacgcggttaacggggaccggtaacggttacgggtaacgtttacgttaaatttaccgttcggtacgtacggttaacctacttttaaacggaacggttaacgaaaccggttaactaaacgtttactttttaccggtttagtaccggtttacggaaaccgggttcgggttaaaccgtaccggttcccgtacgttaaccggtaccggtacaacccggtaccaacggtaccccaacgtcgtcttaccncttaccggttcccacccgttcctacggtctacgttacgtaccgttacgcggtacggtcggttaacnggtacgtaacgg

SEQ ID NO: 262003 - DNA, 741 bp, Homo sapiens
  misc_feature: GYAE6OF02I1YO3.16.46.E02.1.454.CMB.1.raw
  modified_base (236)..(236): a, c, t, g, unknown or other
  misc_feature (236)..(236): n is a, c, g, or t
  modified_base (516)..(516): a, c, t, g, unknown or other
  misc_feature (516)..(516): n is a, c, g, or t
  modified_base (696)..(696): a, c, t, g, unknown or other
  misc_feature (696)..(696): n is a, c, g, or t
  modified_base (705)..(705): a, c, t, g, unknown or other
  misc_feature (705)..(705): n is a, c, g, or t
tcagtgtactactccacgaccggtgctcgatttagactcatctacagggaaaggggctgtgcctgggctctgctcctcctcaccctctcactcagggcacaggatcctgggacctcagtctgccctgactcagcctccctcgtcgtccggtctcctggacagtcagtccacatctccgtgcactggaaccagcagtgacgttggattataccgtgtctcctgacagcaccgccccngcacaccgccccaatctatgtatttagcgaaacgtctaacgtaacgtccggtaccctcggtaccgggttaccctggtacttccggtcctttccgtacggtcgggtacccgtaacggtttcgaccgggaaccaaacccggtcccgtacccctttcccagtaaccccttattcccgtgggtttcccgggcgtaacccgtacgggtcctaaggtaccggggtacctaaggtccttaagttactttaacgtctacggcctaacgtatttaacggtataccgganaccgttaaacttccttttaacgttcggtttaaccttaccgggaaccgttacgtaacccgtagggttccctaacccgtccgttaacgggtccaaccggtacccgtaaccggacccctaacccggtacttacgtcccttaacgttccctacccgtcccctaaaccggttcctaacggtaacncggtaaccncggttacggaccgggcgtacggtagtccgtaacggg

SEQ ID NO: 262004 - DNA, 919 bp, Homo sapiens
  misc_feature: GYAE6OF02FIV9D.16.46.E02.1.454.CMB.1.raw
tcagtgtactactccacgaccggtgctcgatttagactcatctacagggaaagggggctgtgcctgggctctgctcctcctcaccctcctcactcagggcacaggatcctgggctcagtctgccctgactcagcctccctccgtggtccgggtctcctggacagtcgagtcaccatctcctgcacgtaggaaccaggcagtggtacggttggtaagttactaaccggttcgtcctctaggtaccagccaccgaccccgaggccaaccgaccgtacccccaaaacttcaattacgtaattttacgaggtaacgtacgtaaggttaacgtccgggtacccctcgggtaccgggttacccgtagaccgttccgtctttacgttcggtaccgggtaccgtaagttccggtacggaaccaaccgtacccgggtcccctacccgggtagtaacccgtaacgttccgttcccggttaccgggaccccttaccgggtaacgggtaccgttacggggaaacccgggggaccggggtaaccggttaccgttacgggtttaaacttttaaccgtttacggtaccgggttacctccgggttacctaaaccgttaaacgtttaaccggttaaacgttaacggttccggttaccggtttaaccgaacgtttaacgttccggtttttaacgggtttccggggtaaccggggtaaccgggtaaccggtttaacggggtacccggttaacccggtaacgggttaccgtaacggtaccggaaccggtaaccgggtacccggtaccccggtaccccgttacgggtcccttaaccgttcccggttaacccgttccccgtaaccccttaccgttaccggttaacgttaccggttacccgtaacgttccggggtaacgggacccgggttaggtaaccgggg

SEQ ID NO: 262005 - DNA, 741 bp, Homo sapiens
  misc_feature: GYAE6OF02FZQ0D.16.46.E02.1.454.CMB.1.raw
tcagtgtactactccacgaccggtgctcgatttagactcatctacagggaaaggggctgtgcctgggctctgctcctcctcaccctcctcactcagggcacaggatcctgggctcagtctgccctgactcagccctccctccgtgtcccgggtctcctggacagtcagtcaccatctcctgcactggaaccagcagtgtacgttggtagttacgtaaccgtgttctccgtcggtaccagaccacgcccccgaggccaccgaccgaccccccaaactcaactgtactttagtagaagttcgaagttaacgtcccggtcccgtcggaccggggtccccgagtccggtccttccgtcggttcgggtacctaggtccgtcggacgaaccgtaccggtcccttacccgtacgacctacgtcctcgtcggccgtccgacggtcgtacggaggtacgacggtcgtagtacgtttagtacgtgtacgacgttctttaagtaacgtacgaacggtaacctaaacgttaacttttaccgtttacgtaccgtttaacgggtaacgtacgggtaaccctaacgggttcccgtaacccggttcgttaaacgggccctaccggaacccggaaccgtaccccaacccgtctacccgtcctacgttcccgttaccgttacccctaacgttcccgtaacggtacgttaaccgtaccgtacgtcgggaccggtaccggtgtaccggaccgaggtacccg

SEQ ID NO: 262006 - DNA, 665 bp, Homo sapiens
  misc_feature: GYAE6OF02GLOZU.16.46.E02.1.454.CMB.1.raw
  modified_base (229)..(229): a, c, t, g, unknown or other
  misc_feature (229)..(229): n is a, c, g, or t
  modified_base (284)..(284): a, c, t, g, unknown or other
  misc_feature (284)..(284): n is a, c, g, or t
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
  modified_base (626)..(626): a, c, t, g, unknown or other
  misc_feature (626)..(626): n is a, c, g, or t
tcagtgtactactccacgaccggtgctcgatttagactcatctacagggaaaggggctgtgcctgggctctgctcctcctcaccctcctcactcagggcacaggatccgtgggctcagtctgccctgactcacgcctccctccgtgtccgggtctccgtggacagtcagtcacctatcctctgcacgtacggaaccagctaagtgacggttggtagttactaaccggtntccgtctggtaccagcaccgcccgaggcacaccgccccaaatcatgtatttaagngtaacgtcaagtacgtcggcctacggtaccgggtcctagtacgtcgtcttacgtcggtacgggtacctaagtcgtacggaccaacgaccgtcctccgtagacctactcgtcgtcgggcctacggngtcgtagaggacgtagtcgttagtatttacgtcgtnactacgttatatacgagtacgaactaaacttaacttctttaggtacgttacgtaacgtacggtaaccgagtccgtacccgttacgtaggtccaacgaccgaaccgtacccaacccgtacgtacgtacctacttcccgttaccgttaccctcccgtacggtaccgtaacggttacgtaaccnggttaccggtaccggggacggtcgtacggacggtaacgg

SEQ ID NO: 262007 - DNA, 701 bp, Homo sapiens
  misc_feature: GYAE6OF02IPP02.16.46.E02.1.454.CMB.1.raw
  modified_base (273)..(273): a, c, t, g, unknown or other
  misc_feature (273)..(273): n is a, c, g, or t
  modified_base (433)..(433): a, c, t, g, unknown or other
  misc_feature (433)..(433): n is a, c, g, or t
  modified_base (668)..(668): a, c, t, g, unknown or other
  misc_feature (668)..(668): n is a, c, g, or t
tcagtgtactactccacgaccggtgctcgattttagactcatctacagggaaaggggacgtgtgcctgggctctgctcctcctcaccctcctcactcagggcacaggatcctgggctcagtctcgccctgactcagccctccccttccggtggtccgggtcctcctggacagtcagtcacctatctcctgacactaggaaccagcagtgtacgttggtaattactaaccgtgtctcctggaccagcaccgccccaggcacacacccccaaatnatgtatttagagaagtcaacgtagtccggccctacgacggggtccctagactccgtcttcgtcgtacggtacctaagtcgtcgaacaaccgacccggtaccttcccacgaacctacgttcctcggtcgggcctacggaggcgtaggacgggacgacggtnttagttatttaacgtacgtagactaagttaacttaactaacgtaacgaacggtaactaaacttaattttaccgttttacggtaacgtttaccggaaacgtacgggtaaacctacggtccgtaaccggttaccgtagtaacccgaccgacccgaaccggaacccctaaccctagtcgtaccgtaccttccgttacccgtccccgtaccctccgttacgtaacgttacgtaacccgngtaacgggcggtacgggtctacggaactacggg

SEQ ID NO: 262008 - DNA, 810 bp, Homo sapiens
  misc_feature: GYAE6OF02G1N7D.16.46.E02.1.454.CMB.1.raw
tcagtgtactactccacgaccggtgctcgatttagactcatctacagggaaaggggctgtgcctgggctctgctcctcctcaccctcctcactcagggcacaggatccgtgggctcagtctgccctgactcacgcctccctccgtgtccgggtctccgtggacagtcagtcaccatctcctgcacgtggaccagcagtgtacgttggtagttactaccgtgtctccgtggtaccagccacgccccaggccacaccgacccccaatcatgtatttacgagtaatcgaagtacgtccggtacccgtcgggtaaccgggttccctaggaccgttccgttaccgttttccgtccgggttaccgggtacctaacgggttccgtacgggaaccctaaacggtccccggttcccccttacccggaccgtaacccgtacctttcccggttacggtccgggtaccttaccggaacggtcgttaacgggaacggtaacgggtcggttaacttaggtttaaccttttaacgtttacggcgtacccgttaacgtacttttaaaccgtagtttaaaccggtaagggttaacgggtaccggaccctaaccggtacctttaccggtttcccggtaggtttacggtcccggggtacgggttaccggaacgttacggtccgttaccggtacccgttaccggttacggacctacccgtaaccggacgttcccacccggttccccttaggtacctcccggttcctttcccccgtaaccccgtccgtgtaccggtaacgtttcccgaacgtacggttcggcggtacccgg

SEQ ID NO: 262009 - DNA, 501 bp, Homo sapiens
  misc_feature: GYAE6OF01EL6CP.2.26.C04.1.454.CMB.1.raw
  modified_base (497)..(498): a, c, t, g, unknown or other
  misc_feature (497)..(498): n is a, c, g, or t
tcagacgctcgacacacgaccggtgctcgatttagtctagcgactttgggtttggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctccttatccatggtgcatccaccagggccactggtatcccagccaggttcagtggcagtgggtctgggacagagttcactctcaccatcagcagcctgcagtctgaagtattttgctagtttattactgtcagcagtataataactggcgtggacgttcggaccagggaccaaggtgaaatacaaacgactgtggctgcactatctgtcttnntcc

SEQ ID NO: 262010 - DNA, 511 bp, Homo sapiens
  misc_feature: GYAE6OF01A126D.2.26.C04.1.454.CMB.1.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (504)..(505): a, c, t, g, unknown or other
  misc_feature (504)..(505): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctccttanccatggtncatccaccagggccactggtatcccagccaggttcagtggcagtgggtctgggacagagttcactctcaccatcagcagcctgcagtctgaagtattttgctagtttattactgtcagcagtataataactggccgtggacgttcggacgaacgggacaggtaggaaatacgaaacgtactgtggctgcaccatctgtccttnnttcccg

SEQ ID NO: 262011 - DNA, 538 bp, Homo sapiens
  misc_feature: GYAE6OF01B1VEV.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccagggggaaangccaccctctcctgcagggccagtcagagtgttagcggcaacttagcctggtaccagcagaagcctggccagactcccaggctccttatccatggtgcatccaccagggccactggtatcccagccaggttcagtggcaggtgggtctggggacaggagttcactctcaccatcagcagcctgcagtctgaagtatttgctagtttattactgtcagcagtataataacgtggaccgttggacgttcggaccgaagggaccgaagggtaggaaacgtacgaaaacggtaacgtggtaggtctaggaccaccgtatctagttcttcgtattcccg

SEQ ID NO: 262012 - DNA, 507 bp, Homo sapiens
  misc_feature: GYAE6OF01BFAT7.2.26.C04.1.454.CMB.1.raw
  modified_base (203)..(203): a, c, t, g, unknown or other
  misc_feature (203)..(203): n is a, c, g, or t
  modified_base (503)..(503): a, c, t, g, unknown or other
  misc_feature (503)..(503): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatcccaccagggccactggtatcccagccaggttcagtggcagtgggtctgggacagagttcactctcaccatcagcagcctgcagtctgaagtattttgctagtttattactgtcagcagtataataactggccgtggacgttcgaccgaaggaccaaggtgaaatacgaaacgactgtggctgacactatctgtcttcntccg

SEQ ID NO: 262013 - DNA, 524 bp, Homo sapiens
  misc_feature: GYAE6OF01A9QMP.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatccaccagggcccactggtatcccagccaggttcagtggcagtgggtctggggacagagttcactctcaccatcagcagcctgcagtctgaagtattttgctagtttattactgtcagctagtataataactggaccgtggacgttcggaccgaagggaccaagggtaggaaatacgaaaacgactggtaggctgcacctatctgttccttctacttcccg

SEQ ID NO: 262014 - DNA, 555 bp, Homo sapiens
  misc_feature: GYAE6OF01CI0G3.2.26.C04.1.454.CMB.1.raw
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (402)..(402): a, c, t, g, unknown or other
  misc_feature (402)..(402): n is a, c, g, or t
  modified_base (547)..(547): a, c, t, g, unknown or other
  misc_feature (547)..(547): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagagccaccctctcctgcagggccagtcagagtgttagcggcaacttgcctggtacagcagaagcctggccagactccagcctctanccatgncatcccaccgagggccacgtggtactccccgagccgtaggttcaggtggctaggtgggcgtgggacagtagttcacgtctcacatcagcagctgcagtctagaagtntttgactagtttattactgtacagtactaagtaataataacgtggtaccggtggtaccggttcggaaccgtaagggaaccgtaagggtaggtaaaacgtacgaaacgtacgtaggtacggtcacgacaccgtatactgttcttcncgttcccg

SEQ ID NO: 262015 - DNA, 653 bp, Homo sapiens
  misc_feature: GYAE6OF01CMA07.2.26.C04.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
  modified_base (424)..(424): a, c, t, g, unknown or other
  misc_feature (424)..(424): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctcgaaggggaaancgccaccctctcctgcagggccagtcagagtgtagcggcaacttagcctaggtaccagcaagacgcctggaccagacctcccgaggccttaccttatcccagtggtcncactcccacgagggccagtcggtactcccgagcctaggttcagtggctaggtgggtactgggacngtagttcactctacacntcgagcacgcctgctagtcgtagtaagttntttgacttaggttttacttacgtgtactaagtactaagttaacttaaagttaaccgtcgggtacccggtagggtaaccggtttaccgggaacccgtaaacgggggtaaccgtaaagggtaacggtaaaaacgttaaccggaaaaacggtaaccgttagggtacgggtaccctacggtacccaaccgtaacgttaccgttagtttcccgttacgtaaccggttttccccc

SEQ ID NO: 262016 - DNA, 560 bp, Homo sapiens
  misc_feature: GYAE6OF01BZKOR.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactccaggctcctatccatggtgcatccaccgagggccactggtactcccagccaggttcagtggcagtgggtctgggacagtagttcactctcacatcagtcagcctgcagtcgtagaagtattttggactagtttattacgtgtacagctaagttataataactggaccgtaggtaccgttcggaccgtaagggaacccgtaagggtacgtaaagtacgaaaaccgtacgttaggcggtactcggacaaccgtattaccgtagttccttctacgttaccccg

SEQ ID NO: 262017 - DNA, 583 bp, Homo sapiens
  misc_feature: GYAE6OF01CWV1D.2.26.C04.1.454.CMB.1.raw
  modified_base (204)..(204): a, c, t, g, unknown or other
  misc_feature (204)..(204): n is a, c, g, or t
  modified_base (413)..(413): a, c, t, g, unknown or other
  misc_feature (413)..(413): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagcccaccctctcctgcagggccagtcagagtgttagcggcaacttagcctggtaccagcagaagcctggccagacctcccaggctccttatccatggtgcatcccaccagggcccacgtggtactccccgagccctaggttcaggtggctaggtgggtctgggacaggagttcactctcaccatcagcacgcctgcagtctagaagtntttgctagtttacttactgtcagtctaagttataagttaacgtcggtccgtgggtaccgtttacgggaccgtaagggaacccgtaaagggtacgaaacgttaccgaaaacggtaacgttggtacggcttacggaccaaccgtattccgttagttccttcgtcgttccccg

SEQ ID NO: 262018 - DNA, 838 bp, Homo sapiens
  misc_feature: GYAE6OF01CGR7V.2.26.C04.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgccaccctctcctgcagggccagtcagagtgtagcggcaactagcctggacagcagacgctggccagctccaggcctcctatccatggtcncatcccacgagggccacgtggtactcccgagccgtaggttcaggtcggacgtagggttcggggtctaggggactaggtacgtttccaaccttccgtaccaaccctaacgtccgaacggaccaacggtcccttaggaccgtacggttaccgttaagggtaaacggtttacgttttttacggaccgtttaaacggttttttaacgtttaaccgtttacggttaaccgtaaacgggttacgttaaaagggtttaaactttaaaaccggtttaaaaccgggttccgggggtttaaccccggggtttaacgggggtttaaacccggggttttacccgggggaaaccccgggtaaaacgggggtaaacccggttaaaaacgggggttaaaccgggtaaaaaaccggttaaacccggtaaaaaacccgggttaaccggttaggggttaacccgggtaccggttaaccgggtaaccccgtaaacccgttaacggtttaccccggtttaccggttttacccttttacccgtaacccgttttaccccccgg

SEQ ID NO: 262019 - DNA, 521 bp, Homo sapiens
  misc_feature: GYAE6OF01CQA61.2.26.C04.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (514)..(514): a, c, t, g, unknown or other
  misc_feature (514)..(514): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactccaggctcctatccatggtncatcccaccagggccactggtactcccagccaggttcagtggcagtgggtctgggacagngttcactctcaccatcagcagcctgcagtctgaagtatttgctagtttattactgtcagtcagtataataacgtggtccgtggacgttcggaccgaagggaccaagggtagaaactacgaaacgtacgtggtaggctagcacctatctgtcttcncttcccg

SEQ ID NO: 262020 - DNA, 820 bp, Homo sapiens
  misc_feature: GYAE6OF01DEJF6.2.26.C04.1.454.CMB.1.raw
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcaagaagcctggccagacctcccaggctccttatccatggtgcatcccaccgagggccactggtactccccgagccgtaggttcaaggttcgggacgtagggttcggggtccgttagggggaacctaagggtacggttttcccaaccgtttcctacccgtaaccctaacttacccgaacgggtacccaaacgggtcccctttacgggacccgtaaacgggtttcccgtttaagggtaaaacggttttaagtttttttaccgggtaaccttttaaaggtttttttaaaccttttaacccgtttacgggtttaaccctaaaggggtaacccttaaagggtttaaactttaaaacggttttaaacccggttacggggttaacccgggttacggggttaacccgggttttacccgggaaacccgggtaaacggggggtaacccgtaaaaaggggttaacggaaaaaccgtttacggaaaaaaccggtaaacgttacgggttacgggtaccgttacggaccaaccgtactttaccgttagttaccctttctaccgtttaccccg

SEQ ID NO: 262021 - DNA, 534 bp, Homo sapiens
  misc_feature: GYAE6OF01ETMSC.2.26.C04.1.454.CMB.1.raw
  modified_base (203)..(203): a, c, t, g, unknown or other
  misc_feature (203)..(203): n is a, c, g, or t
  modified_base (527)..(527): a, c, t, g, unknown or other
  misc_feature (527)..(527): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcactcccaccgagggccacgtggtactcccagccaggttcaggtggcaggtgggtctggggacagagttcactctcaccatcagcagcctgcagtctagaagtatttgacttagtttattactgtcagtctagtaataataacgtggccgttggacgttcggacgaagggtacaagggtagaaatacgaaacgacgtgtacggctagacactattctagttcttcncttcccg

SEQ ID NO: 262022 - DNA, 529 bp, Homo sapiens
  misc_feature: GYAE6OF01CVFT3.2.26.C04.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangcccaccctctcctgcagggccagtcagagtgtagcggcaacttgcctggtaccagcagaagcctggccagactccagctccttanccatgtncatccacaggccagtgtactcccagcctaggttcaggtggcaggtgggtctggggacaggtagttcactctacaccatcagcagcctgcagtctagtaagtatttgacttagtttatactgtacagctaagtataatacgtggtaccgtggtacgtcggacgaacgggacgaaggtacgaaatacgaaacgtacgtgtacggctgacactactcttagtcttcgtattcccg

SEQ ID NO: 262023 - DNA, 545 bp, Homo sapiens
  misc_feature: GYAE6OF01B27LN.2.26.C04.1.454.CMB.1.raw
  modified_base (537)..(537): a, c, t, g, unknown or other
  misc_feature (537)..(537): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctcctatccatggtgcatcccaccgagggcccatggtactcccagccaggttcaggtggcaggtgggtctggggacaggtagttcactctcaccatcagcagcctgcagtctagtaagtattttgacttagttttattacttgtcagtcaagttaataataacgtggccgtggacgttcggaccgaagggaccgaagggtaggaaatacgaaacggtaactggtacggctagaccaccgtatctagtcttcncgttcccg

SEQ ID NO: 262024 - DNA, 700 bp, Homo sapiens
  misc_feature: GYAE6OF01CQD89.2.26.C04.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttagcctggtaccagcagaagcctggccagactcccaggcctcctanccatggtncatcccaccgagggccacgtggtaactccccgagccgtaaggttcaggttcggactagggttcggggtcctgggggaacctaaggtacggtttccaccttcgtaccaaccctatccgaagtccacggtcccttggctaaggttcctaggtaagttagttttcgacgttaagttttacttacgtgttacctaagtcctaaggttaattaaacgttaaccggttcgggtacccggttaggggtacccggtttaccggggaacccggtaacggggtaaacccgtaaaggggttaacgggtaaaacgttaccgaaaaacggtaaccgttagggttacgggtacctacgggaccctaaacccgtacgttaccgttagtttccctttacgtaccgtttaccccg

SEQ ID NO: 262025 - DNA, 513 bp, Homo sapiens
  misc_feature: GYAE6OF01DIE33.2.26.C04.1.454.CMB.1.raw
  modified_base (203)..(203): a, c, t, g, unknown or other
  misc_feature (203)..(203): n is a, c, g, or t
  modified_base (341)..(341): a, c, t, g, unknown or other
  misc_feature (341)..(341): n is a, c, g, or t
  modified_base (484)..(484): a, c, t, g, unknown or other
  misc_feature (484)..(484): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgtagcggcaacttagcctggaccagcagaagcctggccagactcccaggctcctcatctatgctacattcagcagcgccactggcatcccagacaggttcagtggcnggtgggtctgggacagagttcactctcaccatcagcagactggagcctgaggtattttgctagtgttattactgtcatcgtaggttggtggggtctcgagtcgtgtcgtaggtttcggccgacggggtaccaaggcgtagganagtacgaaacgtaactggtcggcgtgacc

SEQ ID NO: 262026 - DNA, 597 bp, Homo sapiens
  misc_feature: GYAE6OF01C13GQ.2.26.C04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgtagcggcaacttgcctggacagcagagcctgccagacctccaggctccttatccatcggtncactcccaccgagggccacgtggtactcccgagccgtaggttcagtggctaggttgggtctgggacagtacgttcactctcaccatcagcagcctgctagtctagtaagtattttgacttagttttacttacgtgtactagctaagttaacttaaagttaacgtagggtccgttagggtaccgtttccgggaaccggtaacggggaacctaaaggggtacgaaaaactacgaaaaccggtacgtggtacggtctacggacctaacctacgttctacggtttaccttcgtaacgtttccccg

SEQ ID NO: 262027 - DNA, 564 bp, Homo sapiens
  misc_feature: GYAE6OF01EVGCG.2.26.C04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangcccaccctctcctgcagggccagtcagagtgttagcggcaacttgcctggtaccagcagaagcctggccagacctcccaggcctcctatccatggtncactcccaaccgagggcccacgtggtactcccgagccaggttcaggtcggctaggtgggtctggggacaggtagttcactctacacctatcagcacgcctgctagtctagtaagtattttgacttagtttattactgtcagtactagtaataataacgtggccggttaggtacgttcggaccgaagggaccgaaggtacggaaatacgaaacgtacgtaggtacggcgtacgaccacctacgttctgttccttcgcgttcccg

SEQ ID NO: 262028 - DNA, 563 bp, Homo sapiens
  misc_feature: GYAE6OF01D73ZG.2.26.C04.1.454.CMB.1.raw
  modified_base (203)..(203): a, c, t, g, unknown or other
  misc_feature (203)..(203): n is a, c, g, or t
  modified_base (351)..(351): a, c, t, g, unknown or other
  misc_feature (351)..(351): n is a, c, g, or t
  modified_base (538)..(538): a, c, t, g, unknown or other
  misc_feature (538)..(538): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctctcctgcagggccagtcagagtgttagcggcaacttagcctggtaccagcagaagcctggccagactcccaggctcctatccatggtgcatcccaccagggccactggtactcccagccaggttcagtggcagtgggtcngggacagagttcactctcaccatcagcagcctgcagtctagaagtattttgacttaattttatacttgtacagctagttaataagttaaggtcggacctaaaggtaccggttacggaccgaacggggtaccgaaggggtaggaaaagtaccgaaacggtaacgttggtacggcgtagaccaaccgtnttacttacgtcttcgtacttccccg

SEQ ID NO: 262029 - DNA, 546 bp, Homo sapiens
  misc_feature: GYAE6OF01DKIMC.2.26.C04.1.454.CMB.1.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (529)..(529): a, c, t, g, unknown or other
  misc_feature (529)..(529): n is a, c, g, or t
tcagacgctcgacacacgaccggtgctcgatttagtctagcgactttgggtttggggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgccaccctctcctgcagggccagtcagagtgtagcggcaacttgcctggaccagcagaagcctggccagactccaggctcctatccatggtncatcccacgacgggccagtggtacncccagccaggttcagtcgcagtggtcngggacagacttcacttcncacatcagcacgctgctagtctagaagttatttgacttagtttacttactgtcagtcagttaataatacgtggtcgtaggtcgttcggaccgaagggaccaaaggtacggaaactacgaaacggtaacgttggtacggcttacgaccaccgtattacgtnttaccttcacgttcccg

SEQ ID NO: 262030 - DNA, 627 bp, Homo sapiens
  misc_feature: GYAE6OF01CAWVU.2.26.C04.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (421)..(421): a, c, t, g, unknown or other
  misc_feature (421)..(421): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangcccacctctcctgcagggccagtcagagtgtagcggacaacttagcctggtaccagcagaagcctggccagactcccaggcctcttanccatggtncactccaccgagggccacgtggtactcccagccgtaggttcaggtcggctaggtgggtctaggggactaggtacttcactcgtaccaacctatcgagcacgcctgctagtctagtaagtnttttgacttaagttttattacgtgtacagtactaagttaataacttaacgtcgggtaccggttagggtaaccggttccgggaaccggtaacggggtaacccgtaaaggggttaacggaaaacgttaaccgaaaaccggtaagttagggtacggtacgtacgtacccaaaccgttattaccgttacgttccttcctacgtttccccg

SEQ ID NO: 262031 - DNA, 528 bp, Homo sapiens
  misc_feature: GYAE6OF01CEWBM.2.26.C04.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgttagcggcaacttagcctggtaccagcagaagcctggccagactcccaggctccttanccatggtncatccaccagggccactggtactcccagccaggttcaggtggcaggtgggtctggggacaggagttcactctcaccatcagcagcctgctagtctagaagtatttgactagtttattactgtcagtctagtataataacgtcggcgtggacgttcggaccgaagggaccgaaggtagaaactacgaaacgtacgtagtggcngacacctatctagtcttcgntcccg

SEQ ID NO: 262032 - DNA, 526 bp, Homo sapiens
  misc_feature: GYAE6OF01DI0SR.2.26.C04.1.454.CMB.1.raw
  modified_base (203)..(203): a, c, t, g, unknown or other
  misc_feature (203)..(203): n is a, c, g, or t
  modified_base (516)..(516): a, c, t, g, unknown or other
  misc_feature (516)..(516): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttgcctggaccagcagaagcctggccagactcccgaggctccttatccatggtgcatccacagggccactggtatcccagccaggttcagtgcagtgggtctgggacagagttcacttctcacatcagcagcctgcagtctgaagtatttgctagtttattactgtcagctagtataatacgtggccgtaggacgttcggactagggaccgaaggtaggaaactcgaaacgtaacgtggtacggctagacaccgtattactgttaccttntcgttacccg

SEQ ID NO: 262033 - DNA, 633 bp, Homo sapiens
  misc_feature: GYAE6OF01D6ZSJ.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttagcctggtaccagcagaagcctggccagacctcccaggctccttatccatggtgcactcccgaccgagggccacgtggtaactccccgagcccgtaaggttcaggtcggcgaggtcgggtctggggactaggtacgttccacgtctcaacctatccagcacgcctgctagtctagaagttatttgcttagtttacttacgtgtactagtactaagttataaacgtaacgtcggtaccggttgggtaccggtttaccgggaccgtaacggggaacccgtaaagggttacggaaacttaaccgtaaaaccggtaacgttgggtacgggtaccgtacggacctaacccgtacttaccgttaggtttacctttccgtacgtttccccg

SEQ ID NO: 262034 - DNA, 743 bp, Homo sapiens
  misc_feature: GYAE6OF01ATJYS.2.26.C04.1.454.CMB.1.raw
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagacgctcgacacacgaccggtgctcgatttagtctagcgacttttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaagggaaacgacgcccacccttctcctgcgacgggccagtcagtagtgttagcggcaacttagcctggtaccnggcaagagccgtggccagacctccgaggtccttccttanccagtcgggtcncctaactcccgaaccgacgggccctaacggtcggtaacctcccgaagtcccgtaagggttccaagggtggccgtaggggtttcggggtacgtaggggaacctaaggtacgttcctaacctccgtaccaaccgtagtccaacgcgacgtcctgactagttcgtaaggtacgttatttagaactttaattttacgttacgtacgtacgtagtacgtaaagttaagtaagtaagggtaccgtaaccgtaaacggttcccggttaacggaacccggtaaacggggacccggtaaagggttaaccggaaaaacgttaaccggaaaaaccgggtaacgttaggtaaccggggttactaccggtacccgttaaacccgttaaagtttcccggttagtttacccgtttaaccgttaaccgttttccccccg

SEQ ID NO: 262035 - DNA, 507 bp, Homo sapiens
  misc_feature: GYAE6OF01DHRWK.2.26.C04.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (503)..(504): a, c, t, g, unknown or other
  misc_feature (503)..(504): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagcccaccctctcctgcagggccagtcagagtgttagcggcaacttagcctggtaccagcagaagcctggccagactcccaggctccttanccagtggtgcatccaccagggccacgtggtactcccagccaggttcagtggcaggtgggtctgggacagtagtcactctcaccatcagcagcctgcagtctagaatatttgactaatttattactgtcagcagtataatagtagactaagacgttcgacaggacgtaggtagaaatcgaaacgactagtggctagcacatctgtcttnntcc

SEQ ID NO: 262036 - DNA, 555 bp, Homo sapiens
  misc_feature: GYAE6OF01B709R.2.26.C04.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttgcctggtaccagcagaagcctggccagactcccaggcctccttanccagtggtgcatcccaccgagggccacgtggtactcccgagcctaggttcaggtggctaggtgggtctggggacaggtagttcactctcaccatcagcagcctgcagtctagaatatttgactagtttattacgtgtcagtactagttataagtaacgtggtaccgtaggtacgttcggaccggaagggtaaccgtaagggtacggaaatacgaaacggtacgtggtaggctacgcacgtactcgtgtcttcgtcttcccg

SEQ ID NO: 262037 - DNA, 553 bp, Homo sapiens
  misc_feature: GYAE6OF01AD6MV.2.26.C04.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgcccaccctctcctgcagggccagtcagagtgttagcggcaacttagcctggtaccagcagaagcctggccagactcccaggcctccttanccatggtgcatcccaccgagggccacgtggtactcccagccaggttcagtggcaggtgggctgggacaggagttcactctcaccntcagcagcctgcngtctagagtatttgctagtttatactgtcagtctagtataactaacgtggcgtaggtacgttcgaccgaagggaccgtaagggtacgaaactacgaaacgtacgttagggtcggcgtacgcctaaccgtacgttacgtcgttccttcgacgttccccg

SEQ ID NO: 262038 - DNA, 527 bp, Homo sapiens
  misc_feature: GYAE6OF01CH4NC.2.26.C04.1.454.CMB.1.raw
  modified_base (204)..(204): a, c, t, g, unknown or other
  misc_feature (204)..(204): n is a, c, g, or t
  modified_base (352)..(352): a, c, t, g, unknown or other
  misc_feature (352)..(352): n is a, c, g, or t
  modified_base (391)..(391): a, c, t, g, unknown or other
  misc_feature (391)..(391): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgtagcggcaacttgcctggaccagcagaacgcctggccagactcccgaggcctccttatccatggtgcatccaccagggccactggtactcccagccaggttcagtgcagtgggtcngggacagcgttcactctcaccatcagcagcctgctagtntagaagtatttgactagttttatactgtcagtctagtaataataacgtggaccgtggtacgttcggacgaagggaccaaggtagaaacgtacaaacggactggtacgctagacactattctgttcttcgcttcccg

SEQ ID NO: 262039 - DNA, 605 bp, Homo sapiens
  misc_feature: GYAE6OF01DTFXT.2.26.C04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagcccaccctctcctgcagggccagtcagagtgttagcggcaacttagcctggtaccagcagagcctggccagacctcccaggcctccttatccatggtncactcccaccgagggccacgtggtactcccgagcctaggttcagtggcaggtgggtcngggacagtgttcactctcacctatcagcacgcctgcagtctagtaagttntttgacttagttttacttacgtgtactagtactaagttaataagttaacgtgggtaccggttacgggtaccggtttaccgggaccggtaacggggaaccgtaaagggtacggtaaaacgtaacgtaaaacggtaacgttaggtacggtctacggaccaaccgtacttacgttagttccttcgtaccttccccg

SEQ ID NO: 262040 - DNA, 604 bp, Homo sapiens
  misc_feature: GYAE6OF01BX2L9.2.26.C04.1.454.CMB.1.raw
  modified_base (205)..(205): a, c, t, g, unknown or other
  misc_feature (205)..(205): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaanacgcccaccctctcctgccagggccagtcagagtgtagcggcaacttagcctggtaccagcaagagcctggaccagacctcccgaggccttccttatccatggtgcactccaccgaggcctacgtggtactcccgagcctaggtcaggtggcgtaggtgggtctagggacagtacgttcactctacactatcgagcacgtcctgcgtacgtcgtagaattagttttgacttagtttattacgtgtacagtactaagtaattaacgtaacgtcggtaccggttaggtaccggttaccggaaccgaacgggaaccgtaagggtaaggaaaacgtaaccgaaaacggtacgtgggtacggcgttcgacctaccgtatcgttacttcttccgtacttaccccg

SEQ ID NO: 262041 - DNA, 582 bp, Homo sapiens
  misc_feature: GYAE6OF01EITZ6.2.26.C04.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (424)..(424): a, c, t, g, unknown or other
  misc_feature (424)..(424): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcagggccagtcagagtgttagcggcaacttagcctggtaccagcagaacgcctggccagacctcccgaggtcctccttatccatgggtncactcccaccgagggccacgtggtactcccgagccgtaggttcaggtggctagggtgggtctagggacaggtcgttcactcacaccatcagcacgtcctgctagtctagtaagttntttgacttagttttacttactgtcagtactaagttaataataacggtcggtccggtaggtacggttcggacgaacgggaccgtaagggtagaaactaacgaaacggtacgtggtacggtctacgaccaaccgtattcgttagttacttcacgttcccg

SEQ ID NO: 262042 - DNA, 502 bp, Homo sapiens
  misc_feature: GYAE6OF01AXVU4.2.26.C04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
  modified_base (479)..(479): a, c, t, g, unknown or other
  misc_feature (479)..(479): n is a, c, g, or t
  modified_base (497)..(498): a, c, t, g, unknown or other
  misc_feature (497)..(498): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctntcctgcagggccagtcagagtgttagcggcaacttagcctggtaccagcagaagcctggccagactcccaggctccttatccatggtncatccaccagggcccactggtatccccagccaggttcagtggcagtcgggtctggggacaggagttcactctcaccatcagcagcctgctagtctaggaagtattttgctagtttattctgtcagcagtataatactggcgtggcgttcggcaggcaaggtgaaatacgaacgactggngctgcactctctgtcttnntccg

SEQ ID NO: 262043 - DNA, 586 bp, Homo sapiens
  misc_feature: GYAE6OF01BO8JT.2.26.C04.1.454.CMB.1.raw
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
  modified_base (437)..(437): a, c, t, g, unknown or other
  misc_feature (437)..(437): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaancgccaccctctcctgcgagggccagtcaggtagtgtaggcgcaacgttgcctggtaccagcaggaacgccgtggccagacctcccgaggtccttaccttatccgagtcggtnccactcccaccgaggccacgtgtactcccgagcctaggttcaggtggacgtagggtgggtctagggacaggtacgttcactctacactatcacgcacgcctgactagtcgtagtaagttntttgactttagtttatactagtacagtactagtaataacgtacgtcggcgttacggtacggtcggacggtaaggccgaaagggtacgaaagtaaccgaagtacgtgtacggtctacgacctactacttacgtntacgttcncttacccg

SEQ ID NO: 262044 - DNA, 527 bp, Homo sapiens
  misc_feature: GYAE6OF01AXYBM.2.26.C04.1.454.CMB.1.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
  modified_base (521)..(521): a, c, t, g, unknown or other
  misc_feature (521)..(521): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgttagcggcaacttgcctggtaccagcagaagcctggccagactcccaggctccttatccatggtgcactccaccagggccatggtactcccgagccaggttcaggtggctaggtgggtctgggacagtnttcactctcacatcagcagcctgctagtctagtaagtntttgactagtttatacgtgtctagctagtataatacgtggcgtggtacgttcggacgtaagggacctaagggtagaaactacgaaagtacgtgtaggtctagcactactctgtcttcgnttcccg

SEQ ID NO: 262045 - DNA, 708 bp, Homo sapiens
  misc_feature: GYAE6OF01DZC7U.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgccaccctctcctgcagggccagtcagagtgttagcggcaacttagcctggtaccagcagaacgcctggccagactcccgaggcctccttatccatggtgcatcccaccgagggccacgtggtactcccgagccgaggttcaggtcggactaggttggggtctggggaactaggtacgtttccaccgttctaccaacctagtaccgaggaccacgccccttaggccgtaacggttcgttaaggaaacgtttagtttttcggacgtttaagtttttaacttacgttcggtaccagtaccgtaagtttaactaaagttaaccggttcgggtacccggttagggttaccggtttaccgggaccggtaaacggggaacccgtaaaggggttacggaaaaccgttaaccgaaaaccgggtaacgttagggttaacgggtccgtacgggtaaccctaacccgtaagtttccgttacggtttacctttaccgtaccgttttacccccgg

SEQ ID NO: 262046 - DNA, 547 bp, Homo sapiens
  misc_feature: GYAE6OF01C56UE.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggaccagcagaagcctggccagactcccaggctcctcatctatggtgcatcccaacgagggccacgtggtactcccaagccctaggttcagtggcaggtgggtctgggataggagttcactctcaccatcagcacgctgcagttctagtaacgtattttgacttaatttatacgtgtcagtctaagtaataataagtgaccaaaggtacgttacggaccgaagggaccgtaagggtaggaaatacgaaaacggtacgtaggtcggacgtagctaacctatctcgtcttctaccg

SEQ ID NO: 262047 - DNA, 570 bp, Homo sapiens
  misc_feature: GYAE6OF01EG2L9.2.26.C04.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (413)..(413): a, c, t, g, unknown or other
  misc_feature (413)..(413): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctctcctgcagggccagtcagagtgttagcggcaacttgcctggtaccagcagagcctggccagactccaggctctatccatggtncactcccacgagggccacgttggtactcccgagtcccgaggttccaggtcggctagggtgggtctggggacagtacgttcactctacgacctatcaagcagcctgcagtctagaagtntttgcttagtttattacgtgtcagtctaagtaataactaacgtcggaccggttaggtaccgttacggaccgaacgggaccgaagggtacggaaaacgtacgaaacggtacgtaggtacggtctggaccaccgtactcttagttcttcgacgttcccg

SEQ ID NO: 262048 - DNA, 583 bp, Homo sapiens
  misc_feature: GYAE6OF01C4H52.2.26.C04.1.454.CMB.1.raw
  modified_base (202)..(202): a, c, t, g, unknown or other
  misc_feature (202)..(202): n is a, c, g, or t
  modified_base (551)..(551): a, c, t, g, unknown or other
  misc_feature (551)..(551): n is a, c, g, or t
  modified_base (564)..(564): a, c, t, g, unknown or other
  misc_feature (564)..(564): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctcgaggggaanacgccacctctcctgcagggccagtcagagtgtagcggcaacttgcctggtaccagcagaagcctggccagacctccgaggcctcctatccagtggtcgcatcccaccgagggccacgtgtactcccgagtccgtaggttcaggtcggcgtagggtgggtcttggggaactagggtacttccacgttcctaccgaacctataccgagccgtaccgtcctggaccgtagttctaggtaagttattttagacgtttagtttattacctgtcagtactaagtaattaagtaacgtggtccgtaggtacgtcgacgaaggaccgaaggtagaaatacgaaacgtcgtgtacgngtacgcgaacctntacttctctatcgttaccc

SEQ ID NO: 262049 - DNA, 543 bp, Homo sapiens
  misc_feature: GYAE6OF01DJO9U.2.26.C04.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (517)..(517): a, c, t, g, unknown or other
  misc_feature (517)..(517): n is a, c, g, or t
tcagacgctcgacacacgaccggtgctcgatttagtctagcgactttgggtttgggggaggaactgctcagttaggacccagacggaaccatggaagcccccagcgcagcttctcttcctcctgctactctggcctcccagataccactggagaaatagtgctgacgcagtctccagccaccctgtctgtgtctccgaggggaaanacgcccaccctctcctgcagggccagtcagagtgtagcganaactagctggtaccagcagacgctggccagctcccagctctanccagtgncatccacgaggccacgtcgtactcccgagcctaggttcagtcggctaggtcgggtctaggggactaggacgttcactcctacgacctatcgagcacgcctgctagtctagagttntttgactagtttatactgtatagntaagtataatacgtggtcgtgtacgttacggacgaacggacgtagggacgtaacgtaacgaacgtacgtggtacggctacncgaccgtatctgttctcgtcttcccg

SEQ ID NO: 262050 - DNA, 615 bp, Homo sapiens
  misc_feature: GYAE6OF01DF1FJ.2.26.C04.1.454.CMB.1.raw
  modified_base (204)..(204): a, c, t, g, unknown or other
  misc_feature (204)..(204): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgtagcggacaacttagcctggaccagcaagaacgctggccagactcccaggctccttatccagtcggtgccactcccaccgagggccacgtggtactcccgagcctaggttcaggtcggactaggtgggtcgtaggggacaggtacgttccacgttcctacacctatcgagaccacgcctgcacgtctagtaagttntttcgnttagttttacttacgtgtcagtactaagttactaaacgttacgtcggtaccggttagggtaccgttcgggaaccggtaaggaacccgtaaagggtaaggaaacctacgaaaacggtacgttagggtacgtccgtacggaccaaccgtacttcgttacgttaccttcgtcttaccccg

SEQ ID NO: 262051 - DNA, 541 bp, Homo sapiens
  misc_feature: GYAE6OF01EMPCW.2.26.C04.1.454.CMB.1.raw
  modified_base (204)..(204): a, c, t, g, unknown or other
  misc_feature (204)..(204): n is a, c, g, or t
  modified_base (411)..(411): a, c, t, g, unknown or other
  misc_feature (411)..(411): n is a, c, g, or t
  modified_base (534)..(534): a, c, t, g, unknown or other
  misc_feature (534)..(534): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcagggccagtcagagtgttagcggcaacttagcctggtaccagcagaagcctggccagacctcccaggctccttatccatggtgcatcccaccgagggccacgtggtactcccagccgtaggttcaggtggctaggtgggtctgggacaggtagttcactctcaccatcagcacgcctgcagtctagaagtntttgcttagttttatacgtgtcagtctagtaataagtaacgtggccgtggtacgttcggacgaagggacgaaggtagaaactacgaaacgtacgtggtacggctagaccactatctatcttcngttcccg

SEQ ID NO: 262052 - DNA, 668 bp, Homo sapiens
  misc_feature: GYAE6OF01DX2I2.2.26.C04.1.454.CMB.1.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggcctcccagataccactggaagaaatagtgctgacgcagtctccagcccaccctgtctgtgtctccgaaggggaaancgcccaccctctcctgcgagggccagtcagtagtgtagcggacaacttgcctggtaccagacaagacgcctggccagacctcccgagccttccttanccagtggtcncactcccgacggaggccctacgtcgtactcccgagtcctagggttcaggtcggacgtagggttcgggtcgtagggactaggtacgttcaccgttcacgtacatcgagtcacgtcctgcgtacgtcgtagtaagttacgttttagactttaaggtttacttacgtacgtaccgacgttactaagttaacttaaacgtaccgttcgggtaccgttacgggtaccggttaccggaaccggtaacggggaacgtaaagggttaacgaaacgttaaaccgtaaacggtacgttaggtacggtaccgttacgaccgtaccgtacgttaccgttacgtttccttacctcgtttacccccg

SEQ ID NO: 262053 - DNA, 598 bp, Homo sapiens
  misc_feature: GYAE6OF01DC8HZ.2.26.C04.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagagccaccctctcctgcagggccagtcagagtgttagcggacaacttagcctggtaccagcaagaagcctggccagacctccaggctccttanccagtgtncatccacaggccatggtactcccagccaggttcaggtggctaggtcgggtctggggacaggtagtttccacttcgtacaacccatccgagcacgccctgcagtctagaagttgtttacgcttagtttacttactgtcagactagtaataaagttaacgtcggtccgttagggtaccgtttacggaaccgaggggaacctaagggtaacggtaaaacgtaccgaaaaccggtaacgtaggtacggtacgtacgaccaaccgtacttccgttagtttaccttcctacgtttccccg

SEQ ID NO: 262054 - DNA, 679 bp, Homo sapiens
  misc_feature: GYAE6OF01A89KZ.2.26.C04.1.454.CMB.1.raw
  modified_base (205)..(205): a, c, t, g, unknown or other
  misc_feature (205)..(205): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaancgcccaccctctcctgcagggccagtcagagtgttagcggcaacttagcctggtaccagcagaacgcctggccagacctcccgaggccttccttatcccagtcggtcgccactcccgaaccgacgggccctaacgtcgggtactccccgagtcccgtaagggttccaggtcggcgtagggttcggggtcgtggggactaggtacgttccacctccgtaccaaccgtatccgacgcacggtcccgtgaccgtagttacgtaggtaagttagttttacggactttaagttttacttacgttgtactagtactaagttaacttaaacgtaacggtcgggtaccggttagggtaccggttaccgggaaccggaacgggtaaccgtaacgggtaacggtaaacgtaaccgtaaacggtaacgttggtacggtacgtacgacctacgtacttacgttacgttaccttccgtacttccccg

SEQ ID NO: 262055 - DNA, 664 bp, Homo sapiens
  misc_feature: GYAE6OF01CPO00.2.26.C04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgtagcggcaacttagctggtaccagcagaacgcctggccagacctcccaggtcctccttanccagtggtgctactcccgaccgacgggtccagtcggtacctccccgagccgtaggttcaggtggacgtaggtggggtctagggactaggacgttccacttctacgacctagtccgagcctacggccttgactagttactagtaagttagttttcgactttaagttttaacttacgtgtcaacggtctaaggttaattaaacgtaacggttccgggtaccggttagggtaccggtttaccgggaaccggtaacggggtaaccggtaaaggggttaacggaaaacgttaaccggtaaaaacggtacgttacgggttacgggtacgtacggtacctacgtacttaccgttgtttaccttcgtccttacccg

SEQ ID NO: 262056 - DNA, 579 bp, Homo sapiens
  misc_feature: GYAE6OF01D1PO0.2.26.C04.1.454.CMB.1.raw
  modified_base (204)..(204): a, c, t, g, unknown or other
  misc_feature (204)..(204): n is a, c, g, or t
  modified_base (409)..(409): a, c, t, g, unknown or other
  misc_feature (409)..(409): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcagggccagtcagagtgtagcggcaacttgcctggaccagcagagcctggccagacctccaggctccttatccatggtgcatcccaccgagggccacgtggtactcccgagccaggttcaggtggctaggtgggtctgggacaggtgttcactctacacctatcagcacgtcctgctagtctagaagttnttttgacttagtttacttacgttgtactagtactaagttaacttaattaacgttcggtaccggttaggtaccgttccgggacgtaacgggaaccgtaagggtagaaactacgaaacgtacgttggtacggtcgtacgaccaaccgtacttacttattcttcgtcttcccc

SEQ ID NO: 262057 - DNA, 606 bp, Homo sapiens
  misc_feature: GYAE6OF01CRAD3.2.26.C04.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaaggggaaanagcccaccctctcctgcagggccagtcagagtgtagcgacaacttgcctggaccagcagacgcctggccagacctccgagctctancatggncatccacgaggccagtgtacnccagccaggttcaggtcgactagggtgggtactaggggacaggtacgtttccacgttcctacaaccgtatcgacgtcacggtccctagcgtaagttcgtaaggtaaagtttagttttacgattaaacgttttactacgtgtaccaagtactaaagttaattaaagtaaggtcggaaccgtaaaggttccggtacggaaccggaagggaccgtaagggtaacgaaactacgaaaacgtacgtggtacggtctacgacctaacgtattactgttaccttctacgttcccg

SEQ ID NO: 262058 - DNA, 599 bp, Homo sapiens
  misc_feature: GYAE6OF01AN4X4.2.26.C04.1.454.CMB.1.raw
  modified_base (205)..(205): a, c, t, g, unknown or other
  misc_feature (205)..(205): n is a, c, g, or t
  modified_base (470)..(470): a, c, t, g, unknown or other
  misc_feature (470)..(470): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaangcccaccctctcctgcagggccagtcagagtgtagcggcaacttagcctggtaccagcagaagcctggccagacctcccgaggcctccgttatcccagtcggtgcactcccaccgacgggcccacgtcggtactccccgagcccctaaggttccaggtcggacgtaggtcggggtctggggaactagtacgttccaactcctcaccgtataccagcgagccgtgctagtctagtaagtatttgcttagtttattacgtgtcagtntaagtataactaacgtcggccgttaggaccgttacggaccgtaagggaaccgtaaggtacggaaactacgaaaacggtacgtagtacggtctacggacctaccgtacttctagtcctttcgacttcccg

SEQ ID NO: 262059 - DNA, 729 bp, Homo sapiens
  misc_feature: GYAE6OF01E4AY9.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcagggccagtcagagtgttagcggcaacttagcctggtaccagcagagcctggccagacctcccgaggcctaccttatccagtggtgcactcccgaccgagggccctacgttggtactcccagtccgtaggttccaggtcggcagggttcggggtacctaggggaactaggtacgttccaaccgttctaccgaacctagtaccgagtccaacggtcccgtacggacctacggttaccgttaggtaaacgtttacgtttttacggaccgtttaaggtttttaactttaacgttcggttacgtaacggttaccgtaaggtttaaacgttaaacgttaaccggttccgggtacccgggttacgggtaccggtttaccgggaacccggtaaacggggtaaccggtaaaggggttaacggtaaaacgttaaaccggaaaccggtaacgttagggtacggtcgtacggacctaccgtacgttacgttacgtttaccttaccgtaccgtttaccccg

SEQ ID NO: 262060 - DNA, 619 bp, Homo sapiens
  misc_feature: GYAE6OF01COGSN.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttgcctggtaccagcagaagcctggccagacctccaggctccttatccagtggtgcactcccaaccgacgggccacgttggtactccccagcctaggttcaggtgcaggtgggtctagggacagtagttcacgtctacacctatcagcacgaccgtgactagtctagaagttagtttagacgttagtttacttacgtcgtacgagtactaagttaataaactaacgtcggtaccggttaggtacggttccggaaccggtaacgggaaccggtaaagggtaacggaaaacgtaccgtaaaaaccggtacgttaggtacggtacgtacgacctaaccgtacgttaccttagtttcctttacgtacgtttaccccg

SEQ ID NO: 262061 - DNA, 734 bp, Homo sapiens
  misc_feature: GYAE6OF01CY2I4.2.26.C04.1.454.CMB.1.raw
  modified_base (206)..(206): a, c, t, g, unknown or other
  misc_feature (206)..(206): n is a, c, g, or t
tcagacgctcgacacacgaccggtgctcgatttagtctagcgactttgggtttgggggaggaactgctcagttaggacccagacggaaccatggaagcccagcgcagcttctcttcctcctgctactctggctcccagactaccacgtggaagaaatgtgctgacgcagtctcagcccacctgtctgtgtctccgaaggggaaacncgccaccctctcctggccagggcctagtcaaggtagttagttacgcggtactaacgttaggccttagggtaaccaggccaaggaacggcctacgggaccctaacgtacctccccgaaggtccttaccgttagccgtaaggtcggtcacctacgtacccaaccggtacggccctagttaacgggtcctcccggaagcccgtagggttccagggttcggacaggggttcggtacgaggaacgtagtacgtttaccactttccacgactataccgagaccgtaccgacctgtaccgtacggtacgttacgtaagttacgtttacgtacgtttaagtttaagttaccgttagttacgtaacgtacgtaagtttaacgttaaacgtaccggtcgggttaaccggttagggtaaccgttacgggtaaccgtaacggggtaacccgtaaaggggtacgaaataaccggtaaaaccgtcggtaggttacggccttacgaccgtactacgttacgttcgttctacgtacgttccccg

SEQ ID NO: 262062 - DNA, 924 bp, Homo sapiens
  misc_feature: GYAE6OF01DAMHY.2.26.C04.1.454.CMB.1.raw
  modified_base (207)..(207): a, c, t, g, unknown or other
  misc_feature (207)..(207): n is a, c, g, or t
tcagacgctcgacacacgaccggtgctcgatttagtctagcgacttttgggtttgggggaggaactgctcagttaggacccagacggaaccatggaagccccagcgcagcttctcttcctcctgctactctggctcccagataccactggagaaatagtgctgacgcagtctccagccaccctgtctgtgtcctacgaaggggaaanacgcccaccctctcctgcgagggccagtcagtagttgttagcggactaacgttagccgtaggtaccagcgaagtaacgccgtaggacccagacctcccgaggtccttaccgtttaactaccctaagttcgggtacgacctacgtaccccgaacccggtacggggtaccctaaccgttacgggttaaccctcccccgaacggtacccgtaacggggttttccgaacgggtttcgggacgttaacggggttcggggttacgtacggggaaacgtagttaacttttaccgtaaccttccgttaaccgaacctaacgttaccgaacgtccgtaacggttccgttacggaaccgttaaacccgttaaggttaaacggtttaacgtttttacgaaacccctttaaaccttttaacccgttaaaccgtttaccggtaaaccgtaaaacccgttaaaggtttaacccgtttaaacccggtttaacccccggttacccccccgggtttaaggggttaaccccgggttttaaccccggggaaacccggtttaaaaccgggggaaaccccggttaaaagggggttaaaccgtaaaaaccggtaaaccgttaaaaaccggtaaccggttaagggtacgggtaccgttaaccgtacccgtaacgttaaccgttccgtttaccggtttaccttaaccgtacccctttccgtacccccgtccgtttaacccg

SEQ ID NO: 262063 - DNA, 567 bp, Homo sapiens
  misc_feature: GYAE6OF01ALQ3H.2.26.C04.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (442)..(442): a, c, t, g, unknown or other
  misc_feature (442)..(442): n is a, c, g, or t
tcagacgctcgacacacgaccggtgctcgatttagtctagcgactttgggttggggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgttagcgacaacttacgctggtaccagcagaacgcctggccagacctcccgaggcctccttanccatggtcgcactccgaccgacggggcccacgtcggtacctcccgacggccgtagggttcgaggtcggcgtaggttggggtcgtaggggacgaggtacgttacactcctaccaccatcgacgcacgcctgctagtctagtaagtntttgactagtttatctgtcagactagttataactacgtcggtacgtgtacggtcggaccgtaggaccgaaggtacggaaagtacgaaacgtactaggtgcgtagcactactactgtctctcttcc

SEQ ID NO: 262064 - DNA, 631 bp, Homo sapiens
  misc_feature: GYAE6OF01CGJ9Y.2.26.C04.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagngtgtagcggcaacttagcctggtaccagcagaacgccctggccagacctcccaggcctccttatcccagtggtcgcactccacgacggccacgtgtactcccagccgaggttcaggtcgcgtagggtcgggtctgggacaggacgttcgacttcgtaccacctagtaccgagaccgacgtcccgtagcgtacgttctaggtaacgttagttttcgacgtttaagttttacgtttacgtcgtacgtagacttaagtaattaacgttaacgtcgggtaccggttcggtacggttaccggaccggtaacgggtaaccgtaagggtaggtaaacctacgaaacggtaccgtaggtacggtcgtacgtaccaccgtactcgttagtccttcgtacgttccccg

SEQ ID NO: 262065 - DNA, 665 bp, Homo sapiens
  misc_feature: GYAE6OF01C429Q.2.26.C04.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (599)..(599): a, c, t, g, unknown or other
  misc_feature (599)..(599): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccatgganaaatgtgctgacgcagtctcagccacctgtctgtgtcaccgaaggggaaacncgtcccaccctctcctggacgagggccagtcagtagtgtacgcggtacaacgttgccttaggaccagcagacgtcnggcagacctccgagccttacttanccgagtggtcnctacncccacgacgggtcccaagtcggtaccncccgacgtccgtaggttaccagggtcgacgtagggttcggngtacggggactagcgtactacgtctaccacatcancgacgactcgngtagttacgagtaatttcgttagctttaagtttaacttacctgtaaccgaagtcctaaaggttaaccttaagaccggttggacccggttaaggtaacccggttaccggaacgaaacccggggtttagaaacgggtacgtaaaaacgtaccgtaaaaccgggttacgngggttaccggttagacccgtacccaacgttccgaaccttcggtacccttagtcccgtttacccccg

SEQ ID NO: 262066 - DNA, 757 bp, Homo sapiens
  misc_feature: GYAE6OF01CS1A0.2.26.C04.1.454.CMB.1.raw
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (478)..(478): a, c, t, g, unknown or other
  misc_feature (478)..(478): n is a, c, g, or t
  modified_base (728)..(728): a, c, t, g, unknown or other
  misc_feature (728)..(728): n is a, c, g, or t
tcagacgctcgacacacgaccggtgctcgatttagtctagcgactttggggtttgggggaggaactgctcagttaggacccagacggaaccatggaagccccaggcgcagcttcctcttcctcctgctactctggctcccagataccactggaagaaaatgtgctgacgcagtctccagtccaccctgtctgtgtctccgaggggaaacagccctaccctcgtcctggccgacggggtccagttacaggtagttagttacggcggacaacttagccttgggtaaccngtcgtaagaacgccgtggccaaggacctcccgaaggtccttaccttactccctaagttcggtcncctaactaccccgaaccggacgggtccctacggtttacgggtaccctacccgacgtccccgtaaggttcccgaaggttcggacctaggggttcggggttcgtacggggactaagggtacgtttaccncgttcaccgaacctacgtaccacgtacctaccgtccgtcgacgtaacggtcgttaaggtaacggttacgttttcggacgttaacggttttaacgtaaccgtttggtaacctaagggtactaaagttaacttaaacgttaacggtcgggtaccggttagggtaccggtttccgggaaccgtaacgggaacggtaaagggtacgaaaagtaccggaaaacgtacgtaggtacgggtcacggtacctaacgtnttaccgtagttcccttgtacccgttcccg

SEQ ID NO: 262067 - DNA, 772 bp, Homo sapiens
  misc_feature: GYAE6OF01B4X9C.2.26.C04.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccacgtggagaaatagtgctgacgcagtctccagccaccctgtctgtgtctcgaggggaaancgccacctctcngcgaggccagtcagngtgtagcgactatgctggtacagcagacgccgtggccacgacctcccgaggtccttccttatccagtggtcgcactcccgacgacggccacgtcggtactcccgagccgtaggtcaggtcgcgtagggtcgggtacgtgggaacaggtacgttccacctccgtaccaacctataccgacgtaccgacgtccgtacgaccgttacggttactaaggttaaacggttttacgttttacggtacgtttaagttttttaacttaccggtttcgtaaccgttaacgtaaccgttaaagtttaaacgtttaaacggtaaccgggtttaccggggttacccgggttaacggggtttaaccccggggttaacgggtaaccccgggtaaacgggggtaaacccggttaaaacgggggtaaacgggtaaaaccgtttaaacccgggaaaacggttaacccggtttagggtaaccggtccgttacccgtaaacccgtaaccggtacctttaccggttacgtttaacctttcccgttaaacccgtttcccccg

SEQ ID NO: 262068 - DNA, 1039 bp, Homo sapiens
  misc_feature: GYAE6OF01ASBEN.2.26.C04.1.454.CMB.1.raw
  modified_base (273)..(273): a, c, t, g, unknown or other
  misc_feature (273)..(273): n is a, c, g, or t
  modified_base (377)..(377): a, c, t, g, unknown or other
  misc_feature (377)..(377): n is a, c, g, or t
  modified_base (626)..(626): a, c, t, g, unknown or other
  misc_feature (626)..(626): n is a, c, g, or t
tcagacgctcgacacacgaccggtgctcgatttagtctagcgactttgggttgggggagaactgctcagttaggacccagacggaaccatggaagccccagcgcagcttctcttcctacctgcttactcgtcggccttacccaaggacttacccgacgttgggaagtaaaacttggtcgaccgttacggaaccgtcgtaaggttcctaccgaacggccctaacccgttggttaccttcggttcggtacccgttaccggaaagggggtaaaacnccggtacccctaacccgttcgtaccgtggaccgtaacggggcctaggtccgagttacggttcgtaacggcggtaactaacgtttcggaccgttagggtaacccnggtaccgacggtaacggtcccgttagggaccctaacggtacccgtacccggtaaggtccctttaccttaacgacccggtaggttcggtctaccgtaccgttacccggaacggtcgggtaccctacgggttaccggtacctacccggaggttacccggtacggttccgaaggggttaccggcgttaacggggttccgggttacggtaacgggtaaccgttaacggttaaccgttccgtaccggttaaccnccggttaaacccgtagttacccggtaacggtaccgttacccggtaaccggttaccggacgtttaacgggttaccgtaacgggtttaacgttacgggttttaaccgtccggttttaaacgtttaccggttaacccggttacggttaaaccgtcgtttaacggttaaaccgtttaacggtttaccgggtaaacccgtttcggggtaaccgggtttaaccggtacccgggttaaccggtaaacccgggttaacgggtaaacccgggttaaacggggttacttaaaaccccgggtaaacgggtaaccgggttaaccttacgggggtaaccttaccgggttaaccgtaaccggtttacccgttacgggttaccctttaaccggttaccgtttcccggttaacccggtttaacccccgg

SEQ ID NO: 262069 - DNA, 643 bp, Homo sapiens
  misc_feature: GYAE6OF01AD2UR.2.26.C04.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctcgagggaaancgccacctctcctgcagggccagtcagagtgtagcggactaattgcctagtaccagcagacgtcctggccagtacctcccgaggtcttcctaanccagtggtcacactcccgacgaggccacgtggtactcccgagtccgtaggttcaggtcggctaggtcggtctagggacaggtactcgactctcaactatcccgagccgtaacgccgtagacgtacgttacgtagtaagttacttttacggactttacgtttaacttactaggttacgagtactaagtaattaactaacgggttcggtaccggttacggtaaccgttacggtaaccgaacgggtaacccgtaagggtacgaaaacttaaccggaaaaccggtacgttagggtacgacgttacgaccctacgtaacttcgttaccgttacttaacccgtcgttaccccg

SEQ ID NO: 262070 - DNA, 651 bp, Homo sapiens
  misc_feature: GYAE6OF01AQ0YK.2.26.C04.1.454.CMB.1.raw
  modified_base (204)..(204): a, c, t, g, unknown or other
  misc_feature (204)..(204): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcgacgggccagtcagagttgtacgcggcaacttaggcctggtaccagcaagaacgcctggccagacctcccgaggtccttccgttactccagtggtcgcactcccgaaccgacgggccctacgtcggtacctaccccgagcccgtaggttcaggtcggcgtagggtgggtcgtggggaactaggtacgttaccactcctaccacctanccagccgacgcccgtgctagtctagaagttntttacgctttaaggtttacttacgtgtacagtacgtagttaataagttacggtcgggtacccggtacgggttaaccgttcgggaacccggtaacgggtaaccgtaagggtacgtaaaacctacggaaaccgtaaccgttggtacggtcgtacgacctaccgtacttacgttacgcctttcgaccgttaccccg

SEQ ID NO: 262071 - DNA, 819 bp, Homo sapiens
  misc_feature: GYAE6OF01AWUFZ.2.26.C04.1.454.CMB.1.raw
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagacgcccaccctctcctgcagggccagtcagngtgttagcggcaacttagcctggtaccagcagaagcctggccagacctcccgaggtctccttanccagtggtnccatcccgaccgagggccacgtcggtactccccgagcccgtaggttcgaggtcggcgaggttcggggtcgtagggggaacctaggtacgttttaccaccgtttcctacccgaacccgtattcccgacgccgtaaccggtccccgttaggaccgtaacggttccgttaagggtaaacggtttactttttttacggaccgttttaacggttttttaacgtttaaccgtttaggttacccgtaacggttaccgttaaagggtttaaaacgtttaaaccgttttaaaccgggttccgggggttaccccgggtttacgggggttaaccccgggtttaccggggtaaccccgggtaaaccgggggtaaacccggtaaagggggttaaccggtaaaaacgttaaccggaaaaacccgggttaaacggttacgggttacgggtacccgttaccggtacctaaaccccgttactttacccggttacgtttcccgttttacccgtaccgtttaccccccgg

SEQ ID NO: 262072 - DNA, 585 bp, Homo sapiens
  misc_feature: GYAE6OF01CDIPC.2.26.C04.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgtagcggcaacttgcctggtaccagcagacgcctggccagactccaggcctcttanccatggtncatcccacgagggccagtggtactcccgagcctaggttcaggttggcgtaggtcgggtctggggaccaggtaacgttccgacttcctacaccagtccgagccacgtcctagactagtcgtagtaagttattttgacgttagtttattactgtacagtactaagttaataacgttacgtggtaccgtaggtacgttcggacgaacggtaccgaagggtagaaactacgaaacggtacgttaggacggtctacgacccaacgtactacgttagtcctttgccgttcccg

SEQ ID NO: 262073 - DNA, 674 bp, Homo sapiens
  misc_feature: GYAE6OF01EZ7JI.2.26.C04.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (449)..(449): a, c, t, g, unknown or other
  misc_feature (449)..(449): n is a, c, g, or t
tcagacgctcgacacacgaccggtgctcgatttagtctagcgactttgggtttgggggaggaactgctcagttaggacccagacggaaccatgggagccccagcgcagcttctcttcctcctgctactctggctcccagataccactggagaaatagtgctgacgcagtctccagcccaccctgtctgtgtctccgaggggaaancgcccaccctctcctgccagggccagtcagagtgttagcggcaacttgcctggtaccagcagagcctggccagacctccaggtcctccttanccagtcggtnacactcccgaaccgagggcccagtcggtactccccgagtccctagggttccaggtcggacctagggtcgggtcgtaggggactaggtagtttcactctaccacctagtcaagcacgtccgtgactagttctaggtaacgttnttttacgactttaaggttttaacttacgttacgttacgtacgtacttaaggttaattaaacggtaacgggttaccggtaaccgtaaaggttaccggttaccggaaccgggtaacgggtaccgtaaaggggttaacggaaaacgttaaccggtaaacggtacgttagggacggtacctacggaccaaccgttaggttaccttagtttacttaccgccgtttacccg

SEQ ID NO: 262074 - DNA, 584 bp, Homo sapiens
  misc_feature: GYAE6OF01A9TH1.2.26.C04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagacgctcgacacacgaccggtgctcgatttagtctagcgactttggggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaangccaccctntcctgcagggccagtcagagtgttagcggcaacttagcctggtaccagcagaagcctggccagactcccaggctccttatccatggtgcatcccacgagggccacgtggtactcccagcctagggttcaggtggctaggtgggtctggggacaggtagttcacgtctcaccatcagcacgccgtgcacgtctagaacgtatttgactagtttatcgtgtactagtacaagtataagtacgtacggtccgttaggtaccgttcggaccgtaagggtaccgtaaagggtcggaaaacgtacgaaaacgggtacgtaggttcgggaccgttacgacccgtaaccgtattcgtagttccttactacgttcccg

SEQ ID NO: 262075 - DNA, 591 bp, Homo sapiens
  misc_feature: GYAE6OF01BOUAG.2.26.C04.1.454.CMB.1.raw
  modified_base (204)..(204): a, c, t, g, unknown or other
  misc_feature (204)..(204): n is a, c, g, or t
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgcccaccctctcctgcgagggccagtcagagtgttagcgcaacttgcctggtaccagcagaacgcctaggccaagacctcccgaggtcctccttactcccagtcggtcgacactcccaaccgaggggcccacgttggtactcccagtcctagggttcaggtcggctagggtcgggtacgtgggacaggtacgttccactctcaccatcgagcacgcctggctagtcgtagtaagttgtttacgcttagtttattacgtgtctaggtactagttaataacgtaacgtcggaccgtaggtaccgttacggaccgaagggacgtaagggtagaaactacgaaacggtcgtagtacggngtacgcactntcttntcttcgcgttccccg

SEQ ID NO: 262076 - DNA, 808 bp, Homo sapiens
  misc_feature: GYAE6OF01CF7O2.2.26.C04.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (302)..(302): a, c, t, g, unknown or other
  misc_feature (302)..(302): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgcccaccctctcctgcagggccagtcagngtagttagcgntactagcctggtaccagcagaacgccgtggccagacctcccgaggtcctaccgttanccctaagtcgggtacgtccaacttacccgaccgacggggtccctaaccgttagggttaaccctccccgaaggtcccgtaacgggttttacgaacggggttcgggaccgtaaggggtttcggggtaccgttacgggggtaacccgtaggttaaccggtttacccgaccgttaccgttaccgaaaccctacggttaccacggacccgaacgtcccgttcggaaccgtcggttacccgttaaggtaaacggtttatttttacggacgtttaagtttttaacgttaccgttaggttacctaacgtactttaaggtttaactaaacgtttaaccggcgggtaccgggttacgggtaccggtttacccgggaaccggtaaacgggtaaccggtaaaggggttaacgtaaaccgttaaccggaaaaccggttacgttagggtacggtcccgttaacggacccttaaccgttacttacccggttagtttacctttcccgttacggtttcccccg

SEQ ID NO: 262077 - DNA, 789 bp, Homo sapiens
  misc_feature: GYAE6OF01BW1ZD.2.26.C04.1.454.CMB.1.raw
  modified_base (202)..(202): a, c, t, g, unknown or other
  misc_feature (202)..(202): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatgtgctgacgcagtctccagccacctgtctgtgtctccgaggggaaancgccacctctcctgcagggccagtcagagtgttagcgacaacttacgcctaggtaccagcgaagaacgccgtggacccaaggtacctcccgaggtccttacctttaagccctagtcgggtcaccacgtcccaccgaggggcccacgttggtaactcccgagcccgtagggttaccaggttcggcgtaagggttcgggtacgtaggggaacctaggtacgtttaccacgttcctaccgactagtacgacgtcgacgtcgtacgtacgtagttaccgttaaggtaaacgtttacgtttttacggaaccgttttaacgggtttttaacttaaccggtttgttaacccgtaaggtaccgtttaaaggttaaacgtttaaacgttaaccgggttccggggtaccgtttacgggggttaacccggtttccggaacccggggtaaacggggtaaaccgtaaagggttaaccggaaaaacgttaaaccggtaaaaccgggtaacgttacgggttacgggtaaccgtaccggtaaacccgtaacccgttacgttaccgtttacgggtttacccttacgttaacccgttacccccgg

SEQ ID NO: 262078 - DNA, 969 bp, Homo sapiens
  misc_feature: GYAE6OF01CJRE5.2.26.C04.1.454.CMB.1.raw
  modified_base (207)..(207): a, c, t, g, unknown or other
  misc_feature (207)..(207): n is a, c, g, or t
  modified_base (316)..(316): a, c, t, g, unknown or other
  misc_feature (316)..(316): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtcctccgaaggggaaanacgcccaaccctctcctgcgagggccagtcagtagtgtagcggacaacgttagccttggaccagcagaagcctggaccagacctccgaggccttcctatccagtggtcncactcccaccgagggaccctacgtggtactcccgagtccgaaggttcgaggtcggaccgtagggtcgggtcgtacggggaacaggtacgttcgaaccttcgtacccgaccttaacgtccgaagacccgaacgtccccgtagggtacccgttaacggttacgttaacgggttaaaggttttaacgtttttaccgggtaaccgtttttaaacggtttttaaaccgtttaaccggtttacgggttaaccgttaaacgggtaaacccgtttaaaagggtttaaaaacggtttaaaaccggttttaaaacccgggttaccggggggtttaacccccggggtttaaacggggtttaaaccccccggggggtttttaaacccgggggaaaaccccccggggttaaaaacggggggggttaaaacccccgttaaaaaagggggggtttaaaccggtaaaaaaaccccgggtttaaaaccgggttaaaaaaaccccgggttaaccgggtttaaacggggtaccgggtttacccggttaaaccggggttaaaccccccttaaaacccgggtttaaacccggttttaacccgggttttaaacccggttttttcccggttttaaaaccccccggttaacggtttttttcccccccccccccgggg

SEQ ID NO: 262079 - DNA, 598 bp, Homo sapiens
  misc_feature: GYAE6OF01DUYYJ.2.26.C04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgcccaccctctcctgcagggccagtcagagtgtagcgacaacttagcctggtaccagcaagaacgcctggaccagacctccaggctcttatcatggtncatccacgnggccatggtactcccagccaggttcagtggcaggtgggtctgggacagtagttcacgtctcgaacctagtaccgagtaccagtcccgtagcgtaacgttctaggaaagttattttcggacttagtttaacttacgtgtacgagtactaagttaataaacgtacgtcggtaccggttggtaccggttacggaccgtaagggaccgtaaaggtacggaaactacgaaacgtacgtaggtcggtacgtacgacccaacgtacttacgtacgttactctacttaccccg

SEQ ID NO: 262080 - DNA, 704 bp, Homo sapiens
  misc_feature: GYAE6OF01B9CVU.2.26.C04.1.454.CMB.1.raw
  modified_base (207)..(207): a, c, t, g, unknown or other
  misc_feature (207)..(207): n is a, c, g, or t
  modified_base (323)..(323): a, c, t, g, unknown or other
  misc_feature (323)..(323): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaaggggaaacncgcccacctctcctgcagggccagtcagtagtgtagcggactaacgttgccgtaggtaccagacagaacgccgtggaccagacctccgaggtccttaccgttatccagttgggtcnccactcccgacgacgggcctacgtcggtactcccgagtccgtaggttcaggtggcgtagggtcggtacgtaggggaactacggtacgtttccacgttccgtaacaccgtacgttaccgaacggtccgacgtacccgtggaccgtacggttacctaggtaaacgtttagttttacggtactttaacggtttttaactacgttcgttacgtaacgtacgtaaagttactaaacgttacgttcggtaccgggttaggtaccggttacggaaccggtaacgggtaaccggtaagggtaacgtaaaacgtaccgaaaacggttacgtgggtacggtcctacggtacctaacgtcgttacgttacgttaccttccgtcgttaccccg

SEQ ID NO: 262081 - DNA, 792 bp, Homo sapiens
  misc_feature: GYAE6OF01EOXLL.2.26.C04.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagacgctcgacacacgaccggtgctcgattttagtctagcgacttttggggtttgggggaggaactgctcagttaggacccagacggaaccatggaagccccagcgcagcttctcttcctcctgctactctggctcccagataccactggaagaaatagtgctgacgcagtctcagccaccctgtctgtgtcncgaggggaaancgcctacctctcctgcacgggccagtcagtagtgtagcgacaacgttgcctggtaccagacgagaacgccgtggaccaagacctcccgaaggtccttaccttactacccgtagtgggtacaccgtactacccgaacccggagggtacccaacggttcggtaactccccgaaaggtcccgtaagggttttacccgagggtcggtaccgtagggggtcggggttccgtaagggggaacctaagggtaaccgttcctaaccgttcctaccgtaacctagtaccgaacgtccgaaccgtccgtgaccgtaggttacgtaacgtaaagtttgtttacgtactttaaggttttaacttacgttacgtacgtaacggtacttaaagttaacgttaaacgttaaccggtccgggtaccgggtttaacgggtacccggttttaaccgggaacccgtaaacgggggtaacccgtaaaggggttaaccggaaaacgtaaaccgtaaaccgggtacgttacgggtacggtcccttacggaaccccgttaaccgtaacgttccgttaccgtttaccttacgtacccgttttaccccccg

SEQ ID NO: 262082 - DNA, 828 bp, Homo sapiens
  misc_feature: GYAE6OF01EE7YK.2.26.C04.1.454.CMB.1.raw
  modified_base (205)..(205): a, c, t, g, unknown or other
  misc_feature (205)..(205): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtcgtctccgaggggaaancgcccaccctctcctgcgagggccagtcagagttgttacgcggactaacgttacgccgtaggtaccaggcaaggaacgtccgtacggacccaagtacctcccgaggtccttaccttaactcccgtaagttcggggtcacctaaccgtccccgaacccggacggggtacccctaacggttcggtaacctaccccgaacggtacccggttaagggtttccgaagggttcgggcgtacggggttcgggtaccggtaggggaacctagggttacgttccgaaccttccgtaccgaacctacgtaccgaacgtccgtacggtacccgttacggacgttacggttacgtaaggttaaacgtttagtttttacggaaccttttaacggtttttaacgttaccgttcggtaaccgtaacgtacgttaaagttaaacgttaaacggtaccggttccggggtaccgggttacgggttaccgggttaccgggaaccgggtaaacgggtaaccgggtaaagggtaacggtaaaaccgtaaaccggtaaacggttacggttagggttacggaccggttaccgaacccgtaaccgttcgttaccgttaccgtttcttaaccgtccgtttacccccgg

SEQ ID NO: 262083 - DNA, 668 bp, Homo sapiens
  misc_feature: GYAE6OF01E1SDR.2.26.C04.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
tcagacgctcgacacacgaccggtgctcgatttagtctagcgacttttggggtttgggggaggaactgctcagttaggacccagacggaaccatggaagccccagcgcagcttctcttcctcctgctactctggctcccagataccactggagaaatgtgctgacgcagtctcagccaccctgtctgtgtctccgaggggaaancgcccacctctcctgcacgggccagtcagagtgttagcgcacttgcctgtaccngcagagcctggccagactcccagctccttatccagtcggtncactccaccgacggggcctacgttggtactcccgaagtccgtaggttccaggttcggcctagggtcgggtctggggaactacggacgttcaaccgtctcgaacctatacacgtacacgtcccgtgactacgttcgtaggtaaggttacgtttttacggacgttagttttaactttacgtcgttacgtacgtacgttaagttattaaacgtaacgttccgggtaccgtacgggttaccggtttcgggaacccgtaacggggtaaccgtaacggggtaagtaaacgtaaaccgtaaacggttaacgttagggtacggtactacggcctaaccgttacgttaccgttacgttcttaccgttaccgttccccg

SEQ ID NO: 262084 - DNA, 757 bp, Homo sapiens
  misc_feature: GYAE6OF01BSPWC.2.26.C04.1.454.CMB.1.raw
  modified_base (210)..(210): a, c, t, g, unknown or other
  misc_feature (210)..(210): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggaagaaatagtgctgacgcagtctccagcccaccctgtctgtcgtctaccgaaggggaaacncgcccaccctctcctgcgacgggccagtcagagtgtacggcggtactaacgtcgcgtcggacagcaagacgccgtggccaacgcctccgagtccttaccttagtccagtcgtcgaccacgtcccacggtacggcctacgtgtacctccgagtccgagttcaggtcgagtaggttcggcgtgggaacgtagtacgtcctatccgactaacctatccgaggtccacggtccctaggtaccgttacggtaactaggtaaagttttacgttttacgtaaccgttttaaggttttaacttaccggtcgtttaaccaacggttaacgtttaaacgtttaaaacgttaaccgggttaacggttcccgggggtaacccgttttacggggtaaccccgggtttacgggaaaccccggttaaaggggaacccgttaaagggtaaaccggtaaaaccgttaaccgaaaacgggtttacggtacggacgggttacccgtacgtaccttaacccggttacttacgttacccgttacgtttaacccgttcggttacccccg

SEQ ID NO: 262085 - DNA, 740 bp, Homo sapiens
  misc_feature: GYAE6OF01BRURA.2.26.C04.1.454.CMB.1.raw
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagactaccactaggaagtaaatggtgctcgacgcagttccnccacgcccacccgttgtctgtcgtccgtacggaaggggaaanccgccctaccctctccgngccgtacgggccagtacgaggtagtcgttacggcggtactaacgttgccgtaggtaaccagacgaagaacgtccgtacggaccaggtacccnccgacgtcccttaccgtacnccgtatcgggtcactaccnccgaaccgcgactacgtacgtacncccgaagtccgtaggtcgagtggcgtaggggtcggtcgagggacaaggttcctactctaccnctaaccgacgttcgcacgtaccgtcgtcgagttcgtagttacggtaagtttcgtttaagtcggttttaatttacgttacctttaggacgtacgttaattaaacgttaagttaaacggttcggtaccggggttaccgttacggggttaaccggttaccggaaccgggtaaacggaaccgggttaaacgggtaaacgtaaacgtaaccggaaaccggttaaggtcgtacggtaccacggtacccgttacgtcgtttacgttccgttacctccgttccgtacccccgg

SEQ ID NO: 262086 - DNA, 576 bp, Homo sapiens
  misc_feature: GYAE6OF01AHGIH.2.26.C04.1.454.CMB.1.raw
  modified_base (207)..(207): a, c, t, g, unknown or other
  misc_feature (207)..(207): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
tcagacgctcgacacacgaccggtgctcgatttagtctagcgactttgggtttgggggaggaactgctcagttaggacccagacggaacatggaagccccagcgcagcttctcttcctcctgctactctggctcccagataccactggagaaatagtgctgacgcagtctccagcccaccctgtctgtgtctaccgaagggggaaanacgccaccctctcctgcagggccagtcaggagtgtagcggacaacttagcctggtaccagcagaacgcctggccagacctccaggtcctaccttanccagtggtcncactccgacgacggcctacgtgtacncccgacgccgtaggttcaggtcggacgtagggtcgggtacgtgggacaggtacgttcactctcaccatcacgcagcctgctgtctagtattagtttnacttagtttactacgtgtacncgactagtaactagtacgtcggtacgtcggtacgttccggacgtacggacggtaaggtagaaacgtacgaacggtacgtgtacggtcgacgtacacgtcgtctgtccttcgtcttcccg

SEQ ID NO: 262087 - DNA, 641 bp, Homo sapiens
  misc_feature: GYAE6OF01E6B8S.2.26.C04.1.454.CMB.1.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (344)..(344): a, c, t, g, unknown or other
  misc_feature (344)..(344): n is a, c, g, or t
  modified_base (441)..(441): a, c, t, g, unknown or other
  misc_feature (441)..(441): n is a, c, g, or t
  modified_base (516)..(516): a, c, t, g, unknown or other
  misc_feature (516)..(516): n is a, c, g, or t
  modified_base (586)..(586): a, c, t, g, unknown or other
  misc_feature (586)..(586): n is a, c, g, or t
  modified_base (600)..(600): a, c, t, g, unknown or other
  misc_feature (600)..(600): n is a, c, g, or t
tcagacgctcgacacacgaccggtgctcgatttagtctagcgactttgggtttgggggaggaactgctcagttaggacccagacggaaccatggaacgccccagcgcagtcttctcttcctctgctactctggcctcccagactaccagtggaagaaatgtcgctgacgcagtcctccacgcctaccctgtctgtgtcctacggaagggaacnccgccctaccctcgtaccnggcgtacggcagtcaagtaggttcgtacgcgtactacgtacgccgtaggtaccagctaagacgccgtagacccgagtaccctccgagtccttacgtactccgagtcggtacncgtaccgaccgaccggtcggaccctaggttacgtacccgtaccgacgtaccggttagtacgaggtcgacgtagggtcggtaggacgatcgtactacnccgtcacacgcacgcacgccgtctagtactgtacttaagttgtttacgttcgtaacgtttagttactcgtacgtnaacgtagtagtaatcgtacgcggtagtacggtacgtacggaagtaacgacgagtaacgtacaaccggtancggtgtaccgtacncccgtaactacgtccgttactattcccacgttcccgtcccg

SEQ ID NO: 262088 - DNA, 660 bp, Homo sapiens
  misc_feature: GYAE6OF01COXSR.2.26.C04.1.454.CMB.1.raw
  modified_base (627)..(627): a, c, t, g, unknown or other
  misc_feature (627)..(627): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggaagaaatagtgctgacgcagtcctccacgcccacccgttgtcctgtcgtcctaccggaagggggaaacgacgccctaccctctccgacgcgacgggccagtcgagagtggtagcggactaacgttcgccgttaggaccacgacaacgaagccgacggacgacgtacctacccgacggtcctaccttactccctaggtcggtacacctaccgaccctaccggacggtcccacgtacggtacctacccgacgtccgtaggtcgtacggtggacgtagggtcggtacggtagggacacgggtattaccgactcgtaccacctagtcacgacagtcctgctacgtcgtagtaacgttagttcgtacgttagttacttacgtcgtactacgtataaggtaattaaacgtacggtcggacgttcggaccgtacggaacgaacggaaccgaaggtaaggaaacgtaacaaacgacgttgcggtcncgaccacgtacgtcttagtcttcgccgttaccc

SEQ ID NO: 262089 - DNA, 640 bp, Homo sapiens
  misc_feature: GYAE6OF01CKQSD.2.26.C04.1.454.CMB.1.raw
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (372)..(372): a, c, t, g, unknown or other
  misc_feature (372)..(372): n is a, c, g, or t
  modified_base (615)..(615): a, c, t, g, unknown or other
  misc_feature (615)..(615): n is a, c, g, or t
tcagacgctcgacacacgaccggtgctcgatttagtctagcgactttgggttggggaggaactgctcagttaggacccagacggaaccatggaagccccagcgcagcttctcttcctcctgcttactctggctcccagactaccactggagaaatagtgctgaacgcagtctccanccaccctgtctgtgtctccgaaggggaaancgtcccacctctcctgccagggccagtcagtgtagtagcgctaacgtgcgtaggtaccagccaagtagcctaggccagaccnccaggctcttatccagttcgngcattcccacgagggcccaacgttcggtacctaccacgccttaacggttcgacgtcgggaccngggttacggcgttagggactagtagtcacgtcacgtacaatcagccgtaacgccgtcgacgtacgtacgttagtacgttaagttttacgacgtttaattttacgttacgttacgttacacgttaactaacggttattaaacgtaacgttcggtaccgttcggtacgttaccggtaacgaacgggtaccgaaaggttgaaaacttagaaacgtaacggtgaacgtcgtacgaacctaccgtaanccttttgacttgtaccgttaccccg

SEQ ID NO: 262090 - DNA, 756 bp, Homo sapiens
  misc_feature: GYAE6OF01A4GBC.2.26.C04.1.454.CMB.1.raw
  modified_base (317)..(317): a, c, t, g, unknown or other
  misc_feature (317)..(317): n is a, c, g, or t
  modified_base (496)..(496): a, c, t, g, unknown or other
  misc_feature (496)..(496): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggaagaaatagtgctagacgcagtctccagcccaccctgtctgtgtctaccgaaggggaaagacgcccaccctctcccgtgccgaggggccagccgagtagtggttaacgcggactaacgttagcccgtaggtaccaggacgaagtaaccggccgtggacccacggaccncccgacggtcccttaccttacgccgtgttacgggtcgcctaaccttcccgaaccggaccgggtcccgacgttaccgggtacctaccccgacggtaccgtaagggttaccgtagggtacggcgtagggttcggggttacgagggtactaacggtacgttcaccgtactacccaaccgtancgtacgcgaccgtacgtcgacgtacgttacgtagtacgttactttagactttagtttaacttacgttgtacgtactagttaaacgtaagttaacgttaacggtcgggttacccgggttaggttaacccgggttacgggaaccggtaacgggtaacgtaaagggttaacgtaaacggtaaacgtaacggtaacgttagggtacggtaccgtaccggacctaccgtacgttcttaccggttaccttcccgtcgttacccccg

SEQ ID NO: 262091 - DNA, 979 bp, Homo sapiens
  misc_feature: GYAE6OF01CGWH2.2.26.C04.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctcgaggggaangccaccctctcctgccagggccagtcagngtgttagcggactaacgtagcctaggtaccagcaaggaacgccgtggacccaaggacctcccgaagggtccttacccgtttaatcccgtaagttcgggtacgccgtaacttccccgaacccgacgggggtaccccacggttacgggttaaacctcccccggtaaggtaccccgtaaggggttttcccaaacggggttcggtaccgtaaggggtttcgggggttaccctaggggggaaacctaacgggttacgtttaccgacctttaccgtaccctaaaaccccgtaagtttcccggaaacgggtaccgtaacccgggtacccgtttacgggaacccgttaacggttacgttaacgggttaaaagttttacgttttttaccggtacgtttaaacggttttttaacgtttaaccggtttacgttaaccgtaacggttaacccgttaaaggtttaaaccgtttaaacgtttaaaccgggttacccggggttaacccggggtttaaccgggttaaaccccgggggtttttacccggggaaaccccgggtaaaaccggggggttaaaccccggtaaaacgggggttaaacgggttaaaaaccccgtaaaacccgggtaaaaacccgggttaaacccggtttacgggggttaacgggtacccggttaacccgggtaaacccctaacccgttaaaccggtttaccgtttaccggttttaacccgtttaaacccgttcccggttttaaccccccgg

SEQ ID NO: 262092 - DNA, 806 bp, Homo sapiens
  misc_feature: GYAE6OF01CVYY5.2.26.C04.1.454.CMB.1.raw
  modified_base (229)..(229): a, c, t, g, unknown or other
  misc_feature (229)..(229): n is a, c, g, or t
  modified_base (624)..(624): a, c, t, g, unknown or other
  misc_feature (624)..(624): n is a, c, g, or t
tcagacgctcgacacacgaccggtgctcgatttagtctagcgactttgggtttgggggaggaactgctcagttaggacccagacggaaccatggaacgccccagcgcagcttctcttcctcctgctactcgtggcctcccagactaccacgtggaataaatgtgctagacgcagtctaccacgccctacccgttgtcctggttcgtaccgtaccggaaagggggaaacnccgaccctacccgtcttccgaggaccggacgggtccctagtcgaaggtacggttaggttacggccgtaactaaccgttacgtccgttacggaaccgacgacgaaacgacggtcccgtagggaccctacggtaccgtacccggtaggtccctttacgttaacgtaccgtacggttgggtaccaacgtaccgtacccggaaccgaccggtaccctaacggttacccggttaaacccgcccggtaacggttaccggaaccggtttacgacgggttacccggtagggtcggggttaacgggtcggtaacggggtaacctaaacggttccgttaccgtaactccgtaaccacgtacgtacgaacgtcgacgtacgtcgtacgtagtcgtaaggtacgttntttacgcgtttaattcgttacgtgtactagtacttaaggttaagtaacgtggttcccgggaacgttcggttaccggtaacggtacggacggtaacggtaagtaaccgggaaacctaggtaacgtacgtaggactcgtaaccggacctacgttccgtacttcggacttccgtccgttaacccg

SEQ ID NO: 262093 - DNA, 725 bp, Homo sapiens
  misc_feature: GYAE6OF01DLVH4.2.26.C04.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (375)..(375): a, c, t, g, unknown or other
  misc_feature (375)..(375): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagactaccactggaagaaatgtgctgacgcagtctccagcccacctgtctgtcgtctaccgaggggaaacncgcccacctctccgngcgacgggccagtcaggtagttgtacggcgtacaaacgttcgtccgtacggtaccagcgaacgacgtcctacggaccacgacctccgagtcctactagccagtcgcncacnccgacgacggcctacgtcggtactccgacgcgtacggttanacgggtgcggtagggtcgggcgtagggacgtaacgtcgttacaccttccaccaactacgtacccgagaccgaaccggtcccgtagtaccgttagtttacggtaacgttaaagttttcgtttacgtagtttaaccgttttacgttaccgttaggtaccgtaacgtaacttaaaggttaaacttaacggttaaacgggtcggtaaaccgttaaacgggttacgggttaaacccgggaacggtaaccggggtacggtaaagggttaaccgaaaacgtaaccggtaaacgtcggttaggacgtaccacgaccgttaacctacggttacttaccgttacttaccgctttaccccg

SEQ ID NO: 262094 - DNA, 800 bp, Homo sapiens
  misc_feature: GYAE6OF01E4H8U.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaanacgcccacctctcctgcagggccagtcagagtgtacggcggtacaacttgcctaggtaccagcaagacgccgtcggaccagacctcccgaggtcccttaccttactccgagttcggggtcaccgaacctacccgaacccggaacggggtccctaacggtttcggtaaccctcccccgaaggtccccgtaagggtttccgaacggggttcgggacgttaggggtttcggggttaccgtacggggaactagggtaacgtttaccaccttccgtaccaaccctagtaccgagaccgtacggtccctaggcgtacgttctagtaacgtttagttttacggactttacgttttaattaccgttgttaccgtaagtacgttaaggttaacttaaacggttaacccggtaggggtacccggttaacggggttaacccgggtttaaccgggaacccgggtaaaccggggtaaccggtaaaaggggttaacccggtaaaaagtaaaccccgggtaaaaacgttacccgggttagggtaccggtaccggttaaccgacccttaaccgtacgtttcgtaccgttttccttaccgtacgtttccccccg

SEQ ID NO: 262095 - DNA, 654 bp, Homo sapiens
  misc_feature: GYAE6OF01D7IBA.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaancgccaccctctcctgcagggccagtcagagtgtagcggcaacttagcctggtaccagcaagaacgcctggccagacctcccgaggcctaccttatccgtagtcggtgacctactcccaccgacgggccctacgttcggtaactccccgagccgtaggttcgagtcggcgtaggtcgggtctaggggactaggtcgtttacacttcgtaccgactactactacgctacgtccttacgcgtacggttacgtaggtaaacgttagttttacggactttaaggtttttaacttaacgttcgttacgaacgtacgtaattaacttaaagttacgtaggtcccggttaggtaccggttcggaccggtaacggacggtaaggtaggtaaactacgaaacggtacgtggttacggtcgccgtacctacgtacttcgtagttaccttcgtacgttcccg

SEQ ID NO: 262096 - DNA, 779 bp, Homo sapiens
  misc_feature: GYAE6OF01BLYVH.2.26.C04.1.454.CMB.1.raw
  modified_base (162)..(162): a, c, t, g, unknown or other
  misc_feature (162)..(162): n is a, c, g, or t
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
tcagacgctcgacacacgaccggtgctcgatttagtctagcgactttgggtttgggggaggaactgctcagttaggacccagacggaaccatggaagccccagcgcagcttctcttcctctgctactctcggcctcccagactaccacgtaggagaaatagngctgacgctagtctccacgcccaccgtgtctggtgttacctaccggaaggggtaacacgtccccaccttccgtccgtggccgacggcaggtacgagtgtgtaccgcgtactaacgttcgccgtagtaccngacgacgacggtcctacggcacgaccgtccgacgccttacgtctcgtagtggtccactaccgtcccgaacggcccgtactacgttagtacccgacccgtacgtaccgtacggttaccgnggtccggtacggtagggttccgggtagaccggggtaatacggttaccgttcctaaaccttccgtaccgaacctcgaaccgggtcgaccgtacgccgttacgtcgtcgttaaccggtagtaaccgtttagttacgttaacgtttacgtttacgtttacgtacgtaccgtacgtaacgttaacgttaacgttaacgtttaccggtacggtaccgggttaccggttaacgggtaccgggtaaccggaacggttaacccggaaggttaacccgtaaacgttaaaccgggaaccgtaaccggttacgggacgttaccgtaaccgtacgttaccgtacgtttccgttacgttccttacccgttcccgttacccg

SEQ ID NO: 262097 - DNA, 845 bp, Homo sapiens
  misc_feature: GYAE6OF01AEGPW.2.26.C04.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgcccaccctctcctgcacgggccagtcagagtgtagcggacaacgttagccgtggtaccagcagaacgccgtggccagacctccgaggctccttatccatggtncactccgacgacgggccctacgttcggtactaccccgagtccgtaacggtttccgagggttcggaccgtaaggggttcggggttaccgtagggggaacctagggtacgtttaccgaccgtttcctacccgaaccctacgttaccgaacggtaccgtaaccggtcccgtacggtaccgttaacgggttacccgttaacgggtaaacggtttacgttttttaaccgacccttttaaaaccgttttaaccgttaacgttttcgtaacggttaacggtttacgttttaccgttaccggttttaaccgttttttccccggtttccccggtacccggtttaccggttaaccggggtttttacccggggaacccggggttaacgggggtaaacccgttaaaggggtaacggtaacggttaaaccgttaaaccgggtaaaaacccggttacgggtttacgggtaccgggttaccgtaccggtaaccccgttaacccgttaccggtttacctttaccggtttcccgtttaacccgttaccccgg

SEQ ID NO: 262098 - DNA, 670 bp, Homo sapiens
  misc_feature: GYAE6OF01BO9Q6.2.26.C04.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccatggagaaatagtgctgacgcagtcctccagccacctgtctgtcgtctcgagggaancgccaccctctcctgcgacgggccagtcagagttgtacggcggactaacgttagcctacggaccagcaagacgcctggccaagacctccgaggcccttactactccagtggtcnctacacccgacgcggcctacgtcgtaccnccgacgtccgtaaggtccagggtcgtacgtacggggtgggtaccgtaggacgtagtaccgtcaccgtctaccaactacgtacacgacgtaccgcctagtacgtgtacgtaagtaacgttagtttacgtagtttaacgtttacttacgtacttacgagtacgtaaagttaactaacgttacgtacgggtaccggtacggttaccggttaccggaaccgtacgggaaaccgtaggtaaagtaaaccggaacgtaaacggtacgtaggtacgtccgtaacggtaccaaccgttagttaccgttacgttcttaacccgtccgttaccccg

SEQ ID NO: 262099 - DNA, 843 bp, Homo sapiens
  misc_feature: GYAE6OF01ANKTV.2.26.C04.1.454.CMB.1.raw
  modified_base (209)..(209): a, c, t, g, unknown or other
  misc_feature (209)..(209): n is a, c, g, or t
  modified_base (415)..(415): a, c, t, g, unknown or other
  misc_feature (415)..(415): n is a, c, g, or t
tcagacgctcgacacacgaccggtgctcgatttagtctagcgactttggggtttgggggaggaactgctcagttaggacccagacggaaccatggaagccccagcgcagcttctcttcctcctgctactctggctcccagataccatggaagaaatagtgctgacgcagtctccagcccacctgtctgtcgtcgtccgaaggggaaacncgccctaccctctccgtgccgacgggccagtcgagtaggttggttacggccggtacctaaacgttcgccgttacgggtaacccagtacgaacggtaaccggcccgtcgggacccacggaccctacccgaggtcccttaccgttactaccgtggttcggtccgacctaaccgtcccgaccggacgggtaccctacgtacggtacccncccgacggtaccgtaggtccgacggtcggtccgtagggttcgggtacgtacgggactaggttccgtacctaccgtccgacctacgtacgtaccgaacgtccgccgtaccgttaggaccttaggttaccgtaaaggttacgtttacgttttacggaacgtttttaagttttacccgtagttcggtaaccgtacgtttaagtaaacgtttaaagttaccggtaacgggttccgggttaccgggtaaccggggtttacccgggtaacccgggtaaaccgggaaaaggggtacccgggttaaaggtaaaccgttaaaaccggtaaaccggttaaaaccgggttacgttcccggggtaacgtacccgtaacgtaccccgtaaccttcgtttaccgtttaacctcccggtttaacccctttaaccggtcccccg

SEQ ID NO: 262100 - DNA, 946 bp, Homo sapiens
  misc_feature: GYAE6OF01CVJVB.2.26.C04.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
tcagacgctcgacacacgaccggtgctcgatttagtctagcgactttgggtttgggggaggaactgctcagttaggacccagacggaaccatggaagccccagcgcagcttctctcctctgctactctggcctccagactaccacgtggaagtaaatagtgctagacgctagtctccacgccacctgtctgtcgtctacggaagggaagccaccnccctctccngcgacggcagtcgagtagtgtacggccgactaacgttacgccgttacggacacgacgaacgacgccgtacggaccgacgaccgtcccgacgtccttaccgttacaccgtgttccgtgaccgtacctacccggaacgtccggaccgtacgttaaccggtacctacccggaacggtcccggtaaggttacggtaccggtacggtacgtacgggggttacggggtaccggttacggtaacgtaccggttacgtttaacccccgtaacctttacccgacctaaccgtaccgttaaccgggccgtaacctacccggtccggttaacgtaccggtaaacgggtttaccgtaaaggttttaccgtttaagtttaaccgtttaaccggtttaaatttttacccggttaacggtaccgttaaacgtaacggttaaccgtttaaacggtttaaaaaggtttaacggttaaaccgggggttaacgtaaacccgggttaaaacggggtttacccccggttaaacggggggtaaccgggaaacccggggggttttaaaccgggaaagggggtttaaaaaccccggttaaacgtaaaaacccggggtaaaccccgttttaaggggttaaaccggtccggggttaaaccccgtaaccgggtttaaaccccttaaggttaaccccgggtttactttaacccggttttcctaccggttttacccccgtttaccccccgg

SEQ ID NO: 262101 - DNA, 834 bp, Homo sapiens
  misc_feature: GYAE6OF01CDVTT.2.26.C04.1.454.CMB.1.raw
  modified_base (350)..(350): a, c, t, g, unknown or other
  misc_feature (350)..(350): n is a, c, g, or t
  modified_base (438)..(438): a, c, t, g, unknown or other
  misc_feature (438)..(438): n is a, c, g, or t
tcagacgctcgacacacgaccggtgctcgatttagtctagcgactttgggtttggggaggaactgctcagttagacccagacgaaccatggaagcccagcgcagcttctcttcctctgctactctggctcccagactaccactggaagaaatagtgactggacgcagtcctccagccctacccgtgttctgtgtccgtaccggaaggggaaacgacgccccaacccttcgtccgtgacgaggggccagtcagaggttgtacgcggtactaacttagccgttaggaaccagacaaggacgccgtaggccaacggacctcccgaggtcccttccttactccgtagtcggtcnccaacgtcccgacgacgggtcccacgttacggtaccctcccgacggtccctagggttcacgggttcggcgtaggggttccgggtacgngggtaaccaggttcgttaccgtacctcctaaccgacctagtaccgaacgtccgtacggtacccgtgtacccgttaggttacccggttaagttaacgggttttacttttcggtaaaccgttttaaggttttaaccttttaaccggtaccgttaacggtaacgttaacggtttaaaaccggttaaactttaaccggggtttaaccggttacccggggtacccgggtttaaccgggttaacccggggtttaaacccgggaaccgggtaaaaccggggtaaacgggtaaacgggttaaaccggttaaaaccgaaccggttaaaacgtacggtttaccggagttcccgggtacaccttaacggtccgttacgtacgtttcccttaacggtacgttcccccg

SEQ ID NO: 262102 - DNA, 682 bp, Homo sapiens
  misc_feature: GYAE6OF01A6AF9.2.26.C04.1.454.CMB.1.raw
  modified_base (250)..(250): a, c, t, g, unknown or other
  misc_feature (250)..(250): n is a, c, g, or t
  modified_base (312)..(312): a, c, t, g, unknown or other
  misc_feature (312)..(312): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagacgctcgacacacgaccggtgctcgatttagtctagcgactttgggtttgggggaggaactgctcagttagggacccagacggaaccatggaagccccagcgcagcttctcttcctcctgctactctggctcccagataccactggagaaatagtgctgacgcagtctccagccaccctgtctgtgtctccgaggggaaacacgccctaccctcgtcctgcgagggccagtcagagtgtagccggnaacttgcctggtaccagcagaagcctggccagcctcccaggtccttcctatccagtcggtcncactcccaacgcgggccaacgtggtactccccgaagccctaggttcacggtggcgtaggtcgggtcgtagggactaggtcgttcacttccacgaaccngttaccgagtccagtcccgngacctaggttactaaggtaacgtttaacgttttcgtaacgtttacggtttttaacttccgttacgtaccgtaagtcgtaaatttaagtaacttaacggttccgggaccgttaggttacccggttccggaaccggtaacgggaacgaacgggtaaagaaactaacccggaaacggttacgtgggtacggtcctaacggacccttaacgggttacctttacttccggttacctttcccgtaaccgtttcccccg

SEQ ID NO: 262103 - DNA, 766 bp, Homo sapiens
  misc_feature: GYAE6OF01DUCXT.2.26.C04.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (732)..(732): a, c, t, g, unknown or other
  misc_feature (732)..(732): n is a, c, g, or t
tcagacgctcgacacacgaccggtgctcgatttagtctagcgactttggggtttgggggaggaactgctcagttaggacccagacggaaccatggaagcccccagcgcagcttctcttcctcctgcctactctggcctcccagataccactggaagaaatagtgctgacgcagtcctccagcccaccctgtctgtgtcctcgaggggaancgcccacccttcncctgacgagggccagtcgagagttgtacgcggtactaacgttcgcctaggaccagtcaagacgcccgtaggcccaagtacctcccgaggtccttacccgttacaccgtaggttcggtacgacctaacgtcccgaaccggaccggggtccctacggttgtaccctaccccgaggtccctaagggttccgaagtcggaccgtgggttcgggtaccgagggaactacgggtacttccaccggttccctaccaccgtataccgcgtaccgtacgtcccgttagccgtaaggtttaccgtaaggtaaacgtttttgttttaccgtacgttttaagttttactaccggttccgtagtaacgttacgtaaagggttaactttaaacgtaccgggttgggtaccccgggtttgggtaacccggttcggaaccgggtaaccgggacggttaaagggaccgtaaaaccgtacggtaaacccggtagttacgggccggtaaccgttgaaccccgttactnttaccggttatttacccgttatcccgttaccccg

SEQ ID NO: 262104 - DNA, 782 bp, Homo sapiens
  misc_feature: GYAE6OF01BWTM0.2.26.C04.1.454.CMB.1.raw
  modified_base (318)..(318): a, c, t, g, unknown or other
  misc_feature (318)..(318): n is a, c, g, or t
tcagacgctcgacacacgaccggtgctcgatttagtctagcgacttttggggtttgggggaggaactgctcagttaggatccagacggaaccatggaagccccagcgcagcttctcttcctcctgctactctggctcccagataccactggaagaaatagtgctgacgcagtctccagcccaccctgtctgtgtctaccgaagggaacgacgcccaccctctcctgcgacgggccagtcaggagttggttagcggactaacgttagccgttaggaaccagacaacggaccgtccgtggacccaaggtcctaaccccgnggtacccttaccttataccgtaggttcgggtacacctacgtaccccacccggagggtacccacggtttaccggtacctaccccgacggtaccgtacgggttacagggttcggaccgtaggggttcgggtacggtacgggaatacggtaccgtttcaccgtctcccgtaactagtaccgacgacgtaccggtacccgtgtaaccggttacgttacggttaagttaaacgtttgttttacgtacgtttacgtttaacgtttaccgttgtaacccgtagtacgtaacggttaattaaccggtaaccggttgggttaccggtacggtacccgggtaacggtaacccggaaacggggtaaccgtaaaggggttaaccggaaaacttaacccggtaaaaggttacggtacgggacggttacctacggaacccttacggttacctttagtccctttacgttccgtaacccg

SEQ ID NO: 262105 - DNA, 953 bp, Homo sapiens
  misc_feature: GYAE6OF01B9LS4.2.26.C04.1.454.CMB.1.raw
  modified_base (422)..(422): a, c, t, g, unknown or other
  misc_feature (422)..(422): n is a, c, g, or t
tcagacgctcgacacacgaccggtgctcgatttagtctagcgactttgggtttgggggaggaacctgctcagttaggaccagacggaaccatgggaacgccccagcggcaggcttctcttcctcctgctactctggtcctccagactaccacgtagggaacgtaaataggtgaccttggaaccgcgtagttcctccgaacgtacccctacccgtttggttccttacggtcgttacccgtaccgggaaagggggaaaactccgcccctacccgttcgtccgtaggccgacgggtccaggtacgaggtacgttcggtacgccggacttaaacgtggccgtacggtaccacgtcaaggtaccgcctaggcctacgtaccctccggaacggtccctttaccgttacgccgtaaggtttcgggtccnccgtaccgttaaccccggaaccgggaccgggtacctaacggttccggtaaccctacccggtacgtaccggttacggttacgtaacggtcggtacgtaggggttcccggttagacgggtaacgtacggttaccgtacctacccttacgaaccccgtacttacgactaacggtaccgtccggtaccgtagaccggttagttaacgtacggttaaacggtttaccttacggggtttactttaacgttttaaccgttagacggtttaacgaccgttaacggttaacgttaaacgtacgggtttaaccgtcccggggttaaccggttaacggtaccccgggttaacgaaccggggttaacggtaacccgggttaaacgggttaaacgtaaaacccggttaaccgggtaaaacgggttccgggttaaccgggtcgggttttaaccccgacccgggtttaaaccgttacccgtttaacgggttttcccctttaagggtttaaccccgttaccccggttaaaccccggttttaccccgg

SEQ ID NO: 262106 - DNA, 928 bp, Homo sapiens
  misc_feature: GYAE6OF01EKAM7.2.26.C04.1.454.CMB.1.raw
tcagacgctcgacacacgaccggtgctcgatttagtctagcgactttgggtttgggggaggaactgctcagttaggacccagacggaaccatggaagccccagcgcagcttctcttcctcctgctactctggcctcccagactaccacgtggaagaaatgtgctgacgcagtctcacgcctaccctgtctgtgtcgtaccggaaggggaacacgccctaccctcctccgtgccgacggccagtcgaggtagttacggttacggccggtactaacggtttacgcccgttacgggaaccacgtacgaacgggtaaccgtccggttaccgggaaccctaaccggtaacccgttaccccggtaacggttcccctttaaccccgttttaaaccgtcccccggttaaggttttccggggaaccttaccccgtaccccttaacccccgggtaacccgggaacccgggtacccgttaacccgggtttaccgttaaccccgttacccccggaacgggttacccggttacgggttttaaccggcggggttacgggtccgggttaacggggggttcgggtacgggttacggggtaaccgttaaaggggtttacccctttaccgtaaaccgtttccccgaaccgttaaaccctacgttacccggacgtaccgtaccggtacccgttgtaacggttcggttacgttaaggttaacgtttcgttttaacgttacgtttttaaaccgttttgtaccgtttaggtacctacgtaagttaacgtaagtttaacccgttggaccgggtccgggtacgttacgggttaacccggaacggttaaggacccgtaaaggggtacctaaaacgaaccggttaaaccggtgtacgggtacggttccgacgtacccgttactcgttacttaccgtcctttgcccgtttacccg

SEQ ID NO: 262107 - DNA, 826 bp, Homo sapiens
  misc_feature: GYAE6OF01BJFO7.2.26.C04.1.454.CMB.1.raw
  modified_base (222)..(222): a, c, t, g, unknown or other
  misc_feature (222)..(222): n is a, c, g, or t
  modified_base (626)..(626): a, c, t, g, unknown or other
  misc_feature (626)..(626): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggcctacccagactacccacgtaggaagaaatagtggctaggacgcagtcctaccacgcccaccttggtctgtgtccacgggaaggggaacncgccctaccctcgtccgtagacgcgggcctacgtacgaggtacgttagggtacgccgaactaacgtcggtccgttacgggaccaggacgtaacggacgtcccggtagggaccacggacctacccgagttccgttactttacgccagttgggacctctaccgaccggaccggtcggtaccctaggtccgttaaccgtcccacggtaccgttacgggttacgagggtttcggaccggtggggttacccgggtaggtacgggaaccttacgggttacctttccgtaccgtcctacaaaccccggtagtaccgaaccggtcggtaaccggtaccgtacgtccggtaaacggtttgtaaacggttagttttcggttacctaacgggtttttaagttacttcggttaaanccggtaacttagtaaacgggtttaactaacggttacccggttacggtaccggggttacggtaccgggttaacccggaacggggtttaaaccggacgggaaacggggttttaaacaaacgtaaaccccggggtaataccggtgggttaacgcttacgactaccgtaccgttcgttaactccggttaacctccggttacccc

SEQ ID NO: 262108 - DNA, 738 bp, Homo sapiens
  misc_feature: GYAE6OF01ALJ7F.2.26.C04.1.454.CMB.1.raw
  modified_base (131)..(131): a, c, t, g, unknown or other
  misc_feature (131)..(131): n is a, c, g, or t
  modified_base (157)..(157): a, c, t, g, unknown or other
  misc_feature (157)..(157): n is a, c, g, or t
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (479)..(479): a, c, t, g, unknown or other
  misc_feature (479)..(479): n is a, c, g, or t
tcagacgctcgacacacgaccggtgctcgatttagtctagcgactttgggtttgggggaggaactgctcagttaggacccagacggaaccatggaacgccccagcgcagcttctcttcctcctgctactcnggcctcccagactaccacgtgggaanaaagttgtgacctaggaccgctacggttccaccacgccctacccgtgtactcggtccgtccgtaccgggaaaggggaaaccccgtccccaccgtctaccgtcggacggacggctacgntaaggtgtggtacgccgtactaacggtcgccgtagaccngagacggtacnccggcgaccacgtacctcggatccttactcacgtagcgtacnctaccgccgacggctacgtnacgaccctaccgcgttcgtcggtagtacggggtcngggttaggtcgggacgtaggttccgtaacttaatccctacccgacgttaacgacccngtcggaccgctacgccggtgtacgtagttacggtgttaacgttacgtttaacgttacgtttaacctttagttacggtggtaacttcggttaacgtaactttacgtaacgggttaaccgggtcggtttaacccgggttacggttaccgtacgggtaaaccggggtaacgtaacgggtacggaagttaaccgaaccggtaggtacgtgtaacggcgtaaccgacgtcttaaggttcttaaccgtcgtaccgttaccgtccg

SEQ ID NO: 262109 - DNA, 664 bp, Homo sapiens
  misc_feature: GYAE6OF01B2CZT.2.26.C04.1.454.CMB.1.raw
  modified_base (305)..(305): a, c, t, g, unknown or other
  misc_feature (305)..(305): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctcagccaccctgtctgtgtctccgaggggaaagagccaccctctcctgcagggccagtcagagtgtagcggactaacgttgcctaggtaccaggcaagaacgccgtggccagacctcccgaggtccttccttacnccagtcggtcgcactccgaccgtacgggccctacgttggtacctccccgacgccgtaggttaccgagggtggaccgagggttcgggtcgtacggggacaggttacgttcaaccgtttctacccacctagtcgaacgcctacgccctggcctacgttcgtaaggtaattcttttagtacgtttaagttttacttacgtcgttacacgtacttaacgttaataaacgttacggcggtaccgtagggtaccgttccggaaccggtaaggaaccggtaggtaaggaaacgtaaccgaaacggtaccttgggtacgccttacggacctaacgtcgtacgtttagcctttacgctttacccccgg

SEQ ID NO: 262110 - DNA, 798 bp, Homo sapiens
  misc_feature: GYAE6OF01BLFM5.2.26.C04.1.454.CMB.1.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctcggctcccagactaccacgtaggaanaaatgtcgctgaccgctagtccnccgacgccctaccgtgtcctgtccgtaccacggaagggaacnccgccctacctcgtccgngcggaacggccagtacgtagtagttcggtacgacggtactaacgtcgaccgttacgacgagcgaacgtacgccgtcggacctaccgacctacccgtaggtacccttacctaagtccgtaggttcgaccgtacctcccgtaaccccggaccgtacgggtacccctaaggttacccgtaaacccgtcccggaccgttaaccggtacgggttacggcggtacggtacggtaacgggttcggggaccgttaacggggacttaacggtaccttaacccggtacttacccgtaaccgaccgaacttaccgggcgtaaccgtaccgtacgtacgtaacggtacttacgttaaagggtctttaacgtacgggttacttttacgttaactcgtagtccgaagttaccgtaattaaccggttactacgggttaccggacggttcgaccggttaccggaaccggttagaaccggtaaagtacaacgtaaaccgtaggtcgttggtaccgcgttaccgacccgttaccgtacgttcgttaaaccttcctaaacccggttccttaccccggg

SEQ ID NO: 262111 - DNA, 737 bp, Homo sapiens
  misc_feature: GYAE6OF01BRQW6.2.26.C04.1.454.CMB.1.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (507)..(507): a, c, t, g, unknown or other
  misc_feature (507)..(507): n is a, c, g, or t
tcagacgctcgacacacgaccggtgctcgatttagtctagcgacttttgggtttgggggaggaactgctcagttaggacccagacggaaccatggaagccccagcgcagcttctcttcctcctgcctactctggctcccagactaccacgtggaacgaaatagtgctgacgcacgtcctccacgcccaccctgtcttgtcgtcctacggaaggggaaacgaccgcccctaccctctccnggccgacgggccngtcagtacgtgtacggccgtactaacttacggcctacggtaaccagaccgaagacgcccgtacggacccacgacccgtacccgaggtcccttaccgttactccgtaggtcgtccacactcccgaccggtacggaccctaggtccgtcacccgacgccgttaggtccgaggtcggcgtcgggtggtcgaggaactggtacttcacctctaccactcacgcnccgtccncgtcgacttacgtacgtagttaccgttnttacgtacttttaggtttacctacgttcgtaccgtagtacttaagttaaccgttaacggtacgggtttaccgggacggtttaccgggaacgggttaccgggaacggtaaaccgggtagtaaacgggtaaaccgaaacccggtaaccgaaacggtttacgggacgttagggccctaccgttaccgtaccgtaaccgtttgtacccgtttccgttacctccccggtaccccg

SEQ ID NO: 262112 - DNA, 796 bp, Homo sapiens
  misc_feature: GYAE6OF01B5RVQ.2.26.C04.1.454.CMB.1.raw
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
tcagacgctcgacacacgaccggtgctcgatttagtctagcgactttggggtttggggggaggaactgctcagttaggacccagacggaaccatggaagccccagcgcagcttctcttcctcctgctactctggctcccagataccactggagaaatagtgctgacgcatctccagcccaccctgtctgtgtctccgaaagggaagcgccctaccctctccgtgcgagggccagtcgagngtgtagcgactaacgtgcgtggtacngcgagaagccctggccagacctcccgnggtctcccttatcccagtggtcncactcccaccgacggccactggtactccacgcctaggtcaggtcggcgacggtgggtcgtgggacacggtagttcctactcctacgtaacccgacttcgacgtacgaccgtaccgtcgggacttacggttacgttaacggttaaacggttaacgtttttacggttaacgtttaaccggtttttaaacgtttaccggtttacgtttaccgtaaacggtacgttaaacgtttaaagtttaaacgttaaaccgggtttaccggggtacccgggtttaacgggttacccgggttaccggggtaacccgggtaaaaccggggtaaccgggtaaaaccggggttaaacggtaaaaaccggttaaacccggtaaaaaaccggtaaccggtttaacggggttacggtaacccgggtacgtaaccccgtaacccggttaccttaacgttaccggtttacccgttttaccgtaccccgttttaccccccg

SEQ ID NO: 262113 - DNA, 928 bp, Homo sapiens
  misc_feature: GYAE6OF01B0GZ4.2.26.C04.1.454.CMB.1.raw
  modified_base (164)..(164): a, c, t, g, unknown or other
  misc_feature (164)..(164): n is a, c, g, or t
  modified_base (232)..(232): a, c, t, g, unknown or other
  misc_feature (232)..(232): n is a, c, g, or t
  modified_base (639)..(639): a, c, t, g, unknown or other
  misc_feature (639)..(639): n is a, c, g, or t
tcagacgctcgacacacgaccggtgctcgatttagtctagcgactttggggtttgggggaggaactgctcagttaggacccagacggaaccatggaagccccagcgcagcttctcttcctcctgctactctcggctcccagactaccactgggaataaaattgngccgtagacgacctagtcctaccaacggcccaccgttgtccgttgtcgtcgtaccgaagggggaaacncgaccctacccttcgacctggaccgtacggggacctaggtaccaggtacgttgtaacggccggactaaacgttacggccgtacggtaacgacgacgaaggtaacgcccgttacgggaaccctacggtaacccgtacccgtaacgggttccctaaccgtttaccaccgtaaggttcgggtacctacctaaccgttaccccgaaccggtaaccgggtacctaaccggttaccgggtaaccctacccggaaccgtaccggtaacggttaccgtaggtacggaccggtaggggttcggggtacgtacgggtaacgtaacggtacgttacccgtactacctacggaacctaacgtaccgaacgttaccggcgtacccgtaagacgtaacggttccgtaagttaaacggtttntttaacggtactttaaggttttaaactacgttacggtacgtaacgttagggtaaacttaaaggttaaaccgttaacgggttccgggttaccgggtaacgggttaacccgggtaacccggtaaacgggtaaacccgggtaaaggggtaaacggttaaaccgggttaaactaaaaaccggttaaacccggttaacggttacggggttaacgtaaccgggttacggtaaccctaaacggtttaccgttacccggtttattaacccgggttaatttaaaccccggttaacccc

SEQ ID NO: 262114 - DNA, 850 bp, Homo sapiens
  misc_feature: GYAE6OF01CJSDR.2.26.C04.1.454.CMB.1.raw
  modified_base (99)..(99): a, c, t, g, unknown or other
  misc_feature (99)..(99): n is a, c, g, or t
  modified_base (500)..(500): a, c, t, g, unknown or other
  misc_feature (500)..(500): n is a, c, g, or t
tcagacgctcgacacacgaccggtgctcgatttagtctagcgactttgggtttgggggaggaactgctcagttacggacccagacggaaccatggaacncccagcgcagcttctcttcctctgctactctcggcctccagtactaccgacgttggaagtaaagttcgtgctaggacgtctacgtcctccgacgtcccaccgttgtctgtcgtaccgtaccggaaaggggaaactaccgcccgtacctctacggtcgaccgacggtccgtaagtcgaaggttagtacgtacggacgtactaacgtcgtccgttacgacgcgtacgaacgtccggcgtacggaccgtaaccgaccgtccgaacgtccttcgtactcgtagtcgtcaccgtacgtaccgacgacgtcacgttcgacacgtacgtcgtaacgttcgaggtcgtacgttagggtcggtaacgacggtaattacggtccttaactccgttacaccggtcttaccgnggttacgacgttacgacgttaacggtacgtaacgttaacggtagttacgtttaacgttacgttaacgtttaacgtttacgtaacggtacgttaaccggaagtttaacccggttaaagtttaaccggtttaaccgggttaaccggtttaccggggttaaccgggtttaacccggtacgggttaaaccccgggaacgggtaacgggttaaaacccgagggtttaaacgtaaaccgtaaaccggttaaaccggttaacgggttacggttaacccggtaacgttcccggtaaaacccttcggttaaccgttaccgtttacggttaccctttaacccggtttcccgttaacccgg

SEQ ID NO: 262115 - DNA, 790 bp, Homo sapiens
  misc_feature: GYAE6OF01BUU2Q.2.26.C04.1.454.CMB.1.raw
  modified_base (154)..(154): a, c, t, g, unknown or other
  misc_feature (154)..(154): n is a, c, g, or t
  modified_base (234)..(234): a, c, t, g, unknown or other
  misc_feature (234)..(234): n is a, c, g, or t
tcagacgctcgacacacgaccggtgctcgatttagtctagcgactttgggtttgggggaggaactgctcagttaggacccagacggaaccatggaacgccccagcgcagtcttctcttcctcctgctactctggcctaccagataccactgganaaatgtgctagacgcagtctccagcctacctgtctcggtgtcctaccggtaaggggaaactccgcctacccgtctaccgngtcgacgggcctagtcgaaggtcgttaggttacgaccggtacttaacgtcggtaccgtaggtaaccaggacgacggtaacggccttcggacccacgtaccgtcccgaaggtcccttaccgttacgacccgtagtttccgggaactccctaaccggttccccggaaccgggtaccgggtacccctaggtaccggtaacctccccgaaggtccgtaaggttccgacggttcgacggtagggttcgggtacgtacgggataaccggttgtccaccgttcaccgctagtcgacgtaccgcgtacttcgacgtcgttactaacggttacgttacgtttcgtacgtttaagtttacgacgtacgtacgtaacgttacgtaagtttaactaacggttaacggtccgggtaacgggttcgttaccgggtaacgaaccggtaagggtaaccgtaacgggtaaacggtaacctaaaacggtacggttaaccggtgtaacgggtccgttacccgtaaccttacggttacctaccgttaaccggtaccttccgtcccgttaaaccccg

SEQ ID NO: 262116 - DNA, 758 bp, Homo sapiens
  misc_feature: GYAE6OF01DIAVH.2.26.C04.1.454.CMB.1.raw
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
tcagacgctcgacacacgaccggtgctcgatttagtctagcgactttggggtttgggggaggaactgctcagttaggacccagacggaaccatggaagccccagcgcagcttctcttcctcctgctactcgtggcctcccagataccacgtggaagaaatgtgctgacgcagtcctaccacgcccaccctgtcttgtcgtcgtaccggaaggggaaacacgcccctacccttctcccgtggaccgacgggcccagttcaaggtagttggttacggaccggtactaaacgttccgccgtacgggtaaccagaccgaaaggtacccggcgtcggaccacgtaccacccgacggtcccttaccttcnccgtagtcggacgcctaccacccgaaccggaggtccctaacgttcgtaccctcccgagtaccggtacggttangggtcgacggtacgggtgggtaccgttagggactaacggtgttacccaccgttcctaaccgtaacctgaacgtacgcccgtacgtaccttagaccgtagttacgtaagttactttaaggtttctacgtttaattttcgttaacgtcgtacgtaagtactaaaggttaacttaacgttacgggtcggtaccggggttaaccgtcgggttaacccggacgtaaacgggtaccggtaaagggtaactaaaccggtacgtaaacggtacgttggaccggtacgtacgccgtaacctgtttaccgtccttacgtccgtctaccccg

SEQ ID NO: 262117 - DNA, 667 bp, Homo sapiens
  misc_feature: GYAE6OF01B1SNS.2.26.C04.1.454.CMB.1.raw
  modified_base (429)..(429): a, c, t, g, unknown or other
  misc_feature (429)..(429): n is a, c, g, or t
  modified_base (509)..(509): a, c, t, g, unknown or other
  misc_feature (509)..(509): n is a, c, g, or t
  modified_base (539)..(539): a, c, t, g, unknown or other
  misc_feature (539)..(539): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
tcagacgctcgacacacgaccggtgctcgatttagtctagcgactttgggtttgggggaggaactgctcagttaggacccagacggaaccatggaacgccccagcgcagcttctctcctcctgctactctggctcccagactaccactggagaaatagtgctgacgcagtcctccagccacccgttgtcgtgttcgtcctcgaagggaaacgcgccaccctctcctgcgagggacctagtacaaggtgttaggtacggccgtaactaacttacggccgtacggtaaccagacaggtaacgccgtacggtaccaggtaccctccggacgtccgttacctactccgagtcggtctactacctacccgacgacggcctacgtcgtacctccgtacgtacctacgtacgtggtacgtagtagggtcgtacggngacgtagtacttcaccgtctacgtaccgacgttacgacgtccgacgtaccgtgaacgtcgttacgacgttagttacgttntaacgtttattaccgtatggactacgttanacttaagaacttacgggcggtcgtacggtcgtaggacgtaacgggaacgtagtaaccgtagtaaacgtacggtntacggngtacnccggtactacctcgtacttccggtactaccgttcccgttaccg

SEQ ID NO: 262118 - DNA, 741 bp, Homo sapiens
  misc_feature: GYAE6OF01A7Y9M.2.26.C04.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (321)..(321): a, c, t, g, unknown or other
  misc_feature (321)..(321): n is a, c, g, or t
  modified_base (715)..(715): a, c, t, g, unknown or other
  misc_feature (715)..(715): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccacgtggagaaatagtgctgacgcagtcctccagccctaccctgtctggtgtcctaccgaggggaancgccaccctcgtccngcgagggccagtcagagtgtacgcggactaacgttgccgttaggtaccagtcgaagtaacgccgtcggaccagacctccgaggtcctacccgttanccctaggtcgtgacctacgtcccgacggacggccctaggttcggtaacctccccgagcccgtaagggttcagggttacggtcgtagggtcggggtacgtaggggaacctaggtaccgttccaccgttcctaacccgaacctataccgacggtacccgtacggtccctggtacctcggttacgtaacgggttaaacgttcgttttcggtaacgttaagttttaacgttccttaggtccgtagtaacgttagtaaactacgggttaaccgtcgggtaaccgggttcggtaaccggttaccgggaacgggaacggtaccgtaaaggtaacgaaaccgttaaccgaaacgggtacgtaggtaccggtccgtaacgtaaccgtacccgtattaccgttnttacccggttactccgttacccccgg

SEQ ID NO: 262119 - DNA, 877 bp, Homo sapiens
  misc_feature: GYAE6OF01EGNIV.2.26.C04.1.454.CMB.1.raw
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
tcagacgctcgacacacgaccggtgctcgatttagtctagcgactttgggtttgggggagaactgctcagttacggacccagacggaaccatggaagccccagcgcagcttctcttcctcctgcctactctcggctccagataccatgggaataatgtgactggacncagtctaccacgccacctgtctagtcgtctacggagggaacncgccctacctcttaccgcgacgacgggcctagtacgagtacgttaggtacgcgtactaacgtacgtccgtaggaccagcaacggacgtccgtggaccacggtacctaccgacggtcctttaccttacgtactaggttacggttcgaccttaccgacccggtaacccggaaccggtccgttaccggttacgtaacccctaccggtaccgtaccggtagtttcggacggtacggacgtacggggttacgggtacggacgggtacgtaggttacgtcttacgtacccgttacaaaccctagtacgacggtacgtaccgtccgtaggaccgttacggttacgttaagggtaaccgtttttgttaccgtttacgttttaacggttttactttacgtacggttaccggtacttaacgttaagtttaaacggtaaacgttacccgggtttcgggtacccgggtttaacgggttaacccgggttaaccgggtaaacccgggttaaggggtaaaccggggtaaagggttaaacccgggtaaaaccgttaaacccgggttaaaacggtttaaccggttagggttaacccgggtaccgtacggttaacccccgttagttacccggttaacccgttttccggttaaacccggtttaccgtccccggtttttaacccccgg

SEQ ID NO: 262120 - DNA, 511 bp, Homo sapiens
  misc_feature: GYAE6OF02I2DL8.2.26.C04.1.454.CMB.1.raw
  modified_base (202)..(202): a, c, t, g, unknown or other
  misc_feature (202)..(202): n is a, c, g, or t
tcagacgctcgacacacgaccggtgctcgatttagtctagcgactttgggtttggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatccaccagggccactggtatcccagccaggttcagtgcagtgggtctgggacagagttcactctcaccatcagcagcctgcagtctgaagtatttgctagtttattactgtcagtcagttataataacgtggacgtggtacgttcggaccgaaggaccaaggtagaatacgaaacgtactagtaggactgcacatctgtcttcattccg

SEQ ID NO: 262121 - DNA, 503 bp, Homo sapiens
  misc_feature: GYAE6OF02HLB9G.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccacgctcccaggctcctcatctatgctacattcagcagcgccactggcatcccagacaggttcagtggcaggtgggtctgggacagtagttcactctcaccatcagcagactggagccgtgaggtattttgctagttgtattactgtcatcagtgtgggtctcgagcgtgcgtaggtttcggccgtaggggaccaaggcgtaggagatacgaaacgactggtcggctgac

SEQ ID NO: 262122 - DNA, 525 bp, Homo sapiens
  misc_feature: GYAE6OF02HB98S.2.26.C04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctcctatccatggtncatccaccagggccactggtactcccagccaggttcagtggcagtgggctgggacagagttcactctcaccatcagcagcctgcagtctagaagtatttgctagtttattactgtcagtcagttataatagtggacaaagtcgttacgacgaaggaccgagggtagaatacgaaacgaacgtaggtaggactacgacaccgtacttcgtagttcttacattcccg

SEQ ID NO: 262123 - DNA, 751 bp, Homo sapiens
  misc_feature: GYAE6OF02IEBDH.2.26.C04.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (174)..(174): a, c, t, g, unknown or other
  misc_feature (174)..(174): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccaggactaccacgtggaanaatgcnctagcagagtccncgacgaccctacctgtctgtcgtccacggaagggaagccgaccctaccctcctccgtcgacggacggacctacgtacgagtagttagtacggcgaacttaacgtcgtccgtacggtaaccagacgaaggaaccgtcggtccgaccgacgtacccctaccggacgtcccttacttaccactaggttggtcgactacctacccgacggccgacctaggttacgtacccaccgacgtacggttagttaccgaggtcgacggtagggttccgggtacggtacggaacgtaggttacgtacctaccgttcctaacccaaccgtataccgacgaccgaccgtccgtacgacgtacgttgtaacgaagtttcgttcgagttttaagtttacttacgtcgtacgagtacgtaaagttaataaacgttcggtcggtacggttacggttaccggtaccgaaacgggaaacggtaaccgtaaggggtaaacgtaacgtaaccggtaaaacgtcggttaggtaccggtacgtacgaacccgtaacgttacttaccggttccgttaccttacgttacccgtttacccccg

SEQ ID NO: 262124 - DNA, 546 bp, Homo sapiens
  misc_feature: GYAE6OF02G9T0S.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatccaccagggccacgtggtatcccagccaggttcagtggcagtgggtctgggacaggagttcactctcaccatcagcagcctgcagtctgaagtatttgctagtttattactgtctagctagtataagtaactggaccgttggacgttcggaccgaagggtaaccaagggtaggaacgtacgaaacggtaacgttaggtaggacgtaggcctaaccgtagtccttaggtccttactattcccg

SEQ ID NO: 262125 - DNA, 506 bp, Homo sapiens
  misc_feature: GYAE6OF02HZP6K.2.26.C04.1.454.CMB.1.raw
  modified_base (401)..(401): a, c, t, g, unknown or other
  misc_feature (401)..(401): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctccttatccatggtgcatcccaccagggccactggtactcccagccaggttcaggtggcaggtgggtctggggacagagttcactctcaccatcagcagcctgcagtctgaagtnttttgctagtttattactgtcagcagtataatactggcgtggacgttcggaccgaaggacaaggtgaactcgaacgactgtgctgcacatctcgtcttcattccg

SEQ ID NO: 262126 - DNA, 527 bp, Homo sapiens
  misc_feature: GYAE6OF02F2NSE.2.26.C04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtncatccaccagggccactggtactcccagccaggttcagtggcagtgggtctgggacagagttcactctcaccatcagcagcctgcagtctgaagtatttgctagtttatactgtcagcagtataatactggccgtggacgttcggaccaagggaccgtaagggtaggtaactacgaaacgtaacgtaggtacggctacgaccacctatccttgtccttcattcccg

SEQ ID NO: 262127 - DNA, 570 bp, Homo sapiens
  misc_feature: GYAE6OF02HYXLZ.2.26.C04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctcttatccatggtncatcccaccagggcccaacgtggtaactccccagccctagggttcaggtggcctaggtgggtctgggacaggagttcactctcaccatcagcagcctgctagtctagaagtattttgctagtttattactgtcagtcagttaataataacgtggtaccgtggtaccgtttcggaccgtaaagggacccgtaagggtacggaaacgtacgaaacggtaacgttaggtaggtccgtagaccgaccagttccttacggttcttcctattcccg

SEQ ID NO: 262128 - DNA, 515 bp, Homo sapiens
  misc_feature: GYAE6OF02GEPE6.2.26.C04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtncatcccaccgagggccactggtactcccagccaggttcagtggcaggtgggtctgggacagagttcactctcaccatcagcagcctgcagtctgaagtatttgctagtttattactgtcagctagtataatacgtggcgtggtacgttcggaccgaagggaccgaaggtagaatacgaaacgtaactggtggctgacacatctgtcttcatccg

SEQ ID NO: 262129 - DNA, 512 bp, Homo sapiens
  misc_feature: GYAE6OF02GJGPJ.2.26.C04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtncatccaccagggccactggtatcccagccaggttcagtggcagtgggtctgggacaggagttcactctcaccatcagcagcctgcagtctgaagtattttgctagtttattactgtcagcagtataatactggccgtggacgttcggccaaagggaccaagggtaggaatacgaaacgaacgtgtggctgccaccatctgtcttcattccc

SEQ ID NO: 262130 - DNA, 504 bp, Homo sapiens
  misc_feature: GYAE6OF02GMUZS.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatccaccagggccactggtactcccagccaggttcagtggcagtgggtctgggacagagttcactctcaccatcagcagcctgcagtctgaagtatttgctagtttattactgtcagcagtataatactggccgtggtacgttcgcaagggaccaaggtgaatcgaaacgaacgtgtcggctgacacagtctgtcttcatcc

SEQ ID NO: 262131 - DNA, 540 bp, Homo sapiens
  misc_feature: GYAE6OF02JEXAT.2.26.C04.1.454.CMB.1.raw
  modified_base (205)..(205): a, c, t, g, unknown or other
  misc_feature (205)..(205): n is a, c, g, or t
  modified_base (410)..(410): a, c, t, g, unknown or other
  misc_feature (410)..(410): n is a, c, g, or t
tcagacgctcgacacacgaccggtgctcgatttagtctagcgactttgggtttgggggaggaactggctcagttaggaccccagacggaaccatcggaagccccagcgcagcttctcttcctcctgctactctggctcccagataccactggagaaatagtgctgacgcagtctccagccacctgtctgtgtctccaggggaaangccaccctgtcctgcagggccagtcagagtgttagcggcaacttagcctggtaccagcagaagcctggccagactcccaggctccttatccagtcggtgcatccacgagggccacgtggtactcccagcctaggttcaagtggacaggtcgggtctggggacaggtgttcacgtctcacctatcagcagcctgcagtctgaagtntttgctagtttatactgtcagtcagtataataacgtggtaccgtggtaccgttcggacgtaagggaccgaagggtagaactacgtaacgacgtggtaggtctgacacctagtcgtcgtcttcagttcccg

SEQ ID NO: 262132 - DNA, 562 bp, Homo sapiens
  misc_feature: GYAE6OF02II2TW.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatcccaccgagggccactggtactcccagccaggttcagtggcaggtgggtctgggacaggagttcactctcaccatcagcagcctgcagtctagaagtattttgctagttttattactgttcagtctaagtataataacgtgggtaccgttgggtaccggttcggaccgtaaacgggaaccaagggtacggaaactacgaaaacgtacgttaggtcggtacgtcgacctaccgtattccgtgttaccttctattccccg

SEQ ID NO: 262133 - DNA, 544 bp, Homo sapiens
  misc_feature: GYAE6OF02FLCK6.2.26.C04.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttagcctggtaccagcagagcctggccagactcccagctcctanccatggtncatcccacgagggccacgtggtactcccgagccctaggttcaggtcggcaggtcgggtctggggacaggtacgttcacttctacacctatcgagcagcctgcagtctagtaagtatttgacttagtttactactgtcagtctagtataatactggtcgtaggtacgttcggacgaacgggacaaggtagaacgtacgaaacgtaacgtggtacggcgtgacacgtatcgtgtcgttctactcccg

SEQ ID NO: 262134 - DNA, 529 bp, Homo sapiens
  misc_feature: GYAE6OF02GG701.2.26.C04.1.454.CMB.1.raw
  modified_base (301)..(301): a, c, t, g, unknown or other
  misc_feature (301)..(301): n is a, c, g, or t
  modified_base (399)..(399): a, c, t, g, unknown or other
  misc_feature (399)..(399): n is a, c, g, or t
  modified_base (523)..(523): a, c, t, g, unknown or other
  misc_feature (523)..(523): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctccttatccatggtncatcccaccagggccactggtactcccagccaggttcagtggcagtgggtctgggacagagttcactctcacctatcagcagcctgcagtctgaagtntttgctagtttattactgtcagctagttataataactgggccgttaggaccgttcggaccgaacgggaccaagggtagaactacgaaacggtaacgtggtaggctgacacactcgtgtcttacnttcccg

SEQ ID NO: 262135 - DNA, 593 bp, Homo sapiens
  misc_feature: GYAE6OF02IIAHK.2.26.C04.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactccaggcctctatccatggtncatcccacgagggccacgtggtactcccgagccaggttcaggtggctaggtcgggtctgggacagagtttcactctcaccatcagcacgcctgcagtctagaagtattttgacttagttttattactgtacagtcaagttaataataacgtcggaccggtaggtacgttaccgggaccgaaagggtaaccgaaagggtacgggaaactaccgaaaacggtaacgtacgggtacgggtccttacgtacccgaacccgtaagttccgttaggtacccttttaccaacgtttccccg

SEQ ID NO: 262136 - DNA, 515 bp, Homo sapiens
  misc_feature: GYAE6OF02G51H2.2.26.C04.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
tcagacgctcgacacacgaccggtgctcgatttagtctagcgactttgggtttgggggaggaactgctcagttaggacccagacggaaccatggaagccccagcgcagcttctcttcctcctgatactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctcattanccatggtncatccacagggccatggactcccagccagttcagtggcaggtggtctgggacagtagttcactctcacatcagcagcctgcagtctagaagtntttgctaagttttactactgtcagctagtataatacgtcggtcgtaggtacgttcggacgaacgggacaaggtagaaagtacgaaacgactaggtggactagaccacgatctgttctatac

SEQ ID NO: 262137 - DNA, 514 bp, Homo sapiens
  misc_feature: GYAE6OF02F9JG3.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcatccaccagggccactggtatcccagccaggttcagtggcagtgggtctggggacaggagttcactctcaccatcagcagcctgcagtctgaagtattttgctagtttattactgtcagcagtataataatggccgtggacgtttcggaccaagggaccaagggtagaagtacgaaacggtaactgtggctgacacatcgtgtcttcattcc

SEQ ID NO: 262138 - DNA, 564 bp, Homo sapiens
  misc_feature: GYAE6OF02I49DU.2.26.C04.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
tcagacgctcgacacacgaccggtgctcgatttagtctagcgacttttggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgccagggccagtcagagtgttagcggcaacttagcctggtaccagcagaagcctggccagacctcccaggctccttatccatggtgcatccacgagggccactggtactcccagccaggttcaggtgcaggtgggtctgggacngtacttcctccctcaccatccgaagcagtctagacaaactgaggtatttcgactaacttacttcttgtacaacgagtacgtacctaactacctacccgctacctacgtttcgacccgaacggggaccaacggtcggaactcctacgaaacgtacgtcgtaggtactagaccacctacttcgtgttccttactactccttcccg

SEQ ID NO: 262139 - DNA, 556 bp, Homo sapiens
  misc_feature: GYAE6OF02HMHO5.2.26.C04.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccaggggaaangccaccctctcctgcagggccagtcagagtgttagcggacaacgttagcctggtaccagcagaagcctggccagacctcccgaggcctccttatccatggtncatcccaccgagggcccactggtactcccagcccaggttcaggtggctaggtgggtctggggacaggtacgttcactctcacctatcagcacgcctgcagtctagaagttatttcgctagtttattactgtacagtactagtaataactaacgtggaccgttaggaccgttacggaccgaacgggaccgtaagggtagaactacgaaacgtacgtgtggactgacacctgtcctcgttacttactctccg

SEQ ID NO: 262140 - DNA, 573 bp, Homo sapiens
  misc_feature: GYAE6OF02H8N2A.2.26.C04.1.454.CMB.1.raw
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
tcagacgctcgacacacgaccggtgctcgatttagtctagcgactttggttttgggggtagggaacgtgctcagttaggacccagacggaaccatggaagcccagcgcagcttctcttcctctgctactctggctcccagataccactggagaaatagtgctgacgcagtctccagccaccctgtctgtgtctaccgaggggaaacgagcccaccctctcctgcagggccagtcagagtgttagcggcaacttagcctggtaccngcagagcctggccagactccaggctctatccatgtncatccacaggccacgtgtacnccagccaggtcagtcgcaggtggctgggacagagttcacttcncgaccatcgaagcacgctgcagtctagaagtatttgactaggtttatactgtaccagtcaagttaataactaacgtggaccgttaggacgtttaccgggaccggaaacggtaaccgtaacgggtaggtaaaccgtacgaaaccggaacgttacggtcggtacgtacgccgaaccgtacgtccgttacggttccttacgtacttacccg

SEQ ID NO: 262141 - DNA, 808 bp, Homo sapiens
  misc_feature: GYAE6OF02F3XEB.2.26.C04.1.454.CMB.1.raw
  modified_base (774)..(774): a, c, t, g, unknown or other
  misc_feature (774)..(774): n is a, c, g, or t
tcagacgctcgacacacgaccggtgctcgatttagtctagcgactttgggtttgggggtaggggaactgctcacgttaggacccacgacggaaccatggaacgccccagcgacacgcttctcttcctcccttcgctacctctggcctccgacgtagtaccgactcggagtaaattggtggctaggacgacgacgtcctaccgagccccaaccctccgtcgtggtcgtaccgtccgtaagggggaagacgacccgtaccctcggtcctggacggtacgggaccgaagtccagggacgttcgttacggcggacgtaacgttaccgccgtacggtaaccgcgtaccaggaacgtcccgtacggtcccaaccggaccctaccccgaggtcccttaccccttaactcccggtagtcgggtacgacgtaccctacccgaaccggaacggggcccctaggtgggtaacctacccgacgggaccgtagggttaccacggtaccgaacgtaggggttcggggttaccgtacgggaacctaaacggtcgttacccgaccgttacctacgtaaacccgttagtaccggacgacggtaccgacccgtagtaccgtacggtacgacggtaaacgtttacttacgacttaaggtttactacgtgtaccgagtactaggtaataacgtacggtcggtaccggtacggtccgttacggaacgtaacgggtaccgtaggtaacgaactaacggaacgttaacttcggttaacgcgtacgaccgtaacggtnttaccggttaggtccttacgtacggtttaccccg

SEQ ID NO: 262142 - DNA, 572 bp, Homo sapiens
  misc_feature: GYAE6OF02H48MV.2.26.C04.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
tcagacgctcgacacacgaccggtgctcgatttagtctagcgactttgggtttgggggagggaactgctcagttaggacccagacggaaccatggaagccccagcgcagcttctcttcctcctgctactctggctcccagataccactggagaaatagtgctgacgcagtctccagccaccctgtctgtntctccgaggggaaangccaccctctcctgcagggccagtcagagtgtagcggcaacttgcctggtaccagcaagaacgcctggccagacctcccgaggcctcttanccatggtncatcccacgacgggccacgtgtacncccagcctaggtcaggtgcagtcgggctgggacagtagttcactctacaccatcagcagcctgctagtctagaacgttagttttgcttaagtttaattactcggttacagtctaagttaataaacgttaacgtcgggccgtagggtacgtttcgggaacccgtaaggaaccggtaaggtacgggaacttacgaaacgaacgtcggtagctaggacctacgtatactggttactacgtatcccg

SEQ ID NO: 262143 - DNA, 600 bp, Homo sapiens
  misc_feature: GYAE6OF02G92DZ.2.26.C04.1.454.CMB.1.raw
  modified_base (204)..(204): a, c, t, g, unknown or other
  misc_feature (204)..(204): n is a, c, g, or t
  modified_base (402)..(402): a, c, t, g, unknown or other
  misc_feature (402)..(402): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagngccaccctctcctgcagggccagtcagagtgttagcggcaacttagcctggtaccagcagaagcctggccagactcccaggcctccttatccatggtgcatccaccgagggccactggtactcccagccaggttcaggtggcagtgggtctgggacagtagttcactctcaccatcagcacgcctgcagtctgaagtnttttgacttagtttacttacgttgtctagctaaggttaattaacgtaacgtcgggtaccgttagggtaccggttccgggaaccgtaacggggaacccgtaaggggttacggaacgttaccgtaaacggtaaccgttagggtacggtacgttacggacctaccgtacgttaccgttcggttaccttcgtacgttccccg

SEQ ID NO: 262144 - DNA, 540 bp, Homo sapiens
  misc_feature: GYAE6OF02F58U6.2.26.C04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctctcctgcagggccagtcagagtgttagcggcaacttagcctggtaccagcagaagcctggccagactcccaggctccttatccatggtncatccaccagggccactggtactcccagcccaggttcagtggcagtgggtctggggacaggagttcacgttctaccacctatcagcacgcctgcagtctagaagtatttgcttagtttattactgtcagtctagttataataacgtggaccgttaggtacgttcggacgaacgggacgtaaggtaggaatacgaaacgtacgtaggtacggctcgacacctatcgttgtcttcacttccc

SEQ ID NO: 262145 - DNA, 674 bp, Homo sapiens
  misc_feature: GYAE6OF02ITGYP.2.26.C04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanacgccaccctctcctgcagggccagtcagagtgttagcgacaacttagcctggtaccagcagaacgcctggccagactcccgaggctcctatccatggtncatcccacgacgggccacgtggtactcccagccgtaggttcaggtcggctaggtcgggtactggggacaggtacgttcacgttctacacctatcgaacgcgacgtccgtacggactacgttactaggtaaacgttagttttcggtacgttaagttttaactttacgttcgttactaagtacgtaaggttaaacttaaacggttaaaccgttcgggtacccgggttaaggttaacccggtttaccgggaacccggtaaagggtaacccgtaagggttaacggaacgttaaacggtaaaccggtaacgtacggttacggtacgttacgaccgtaccgtagttaccgttacgttacctttcgtaccttacccg

SEQ ID NO: 262146 - DNA, 503 bp, Homo sapiens
  misc_feature: GYAE6OF02HRXR6.2.26.C04.1.454.CMB.1.raw
  modified_base (203)..(203): a, c, t, g, unknown or other
  misc_feature (203)..(203): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctctcctgcagggccagtcagagtgttagcggcaacttagcctggtaccagcagaagcctggccagactcccaggctccttatccatggtgcatccaccagggccatggtactcccagccaggttcagtggcagtgggtctgggacagtgttcactctcaccatcagcacgcctgcagtctagaagtattttgctaagtttattactgtacagctagtataatacgtgcgtggacgttcgacgaaggaccgaaggtgaatcgaaacgatggagctagcacnctctgtctcntcc

SEQ ID NO: 262147 - DNA, 581 bp, Homo sapiens
  misc_feature: GYAE6OF02I2J4A.2.26.C04.1.454.CMB.1.raw
  modified_base (205)..(205): a, c, t, g, unknown or other
  misc_feature (205)..(205): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagngccaccctctcctgcagggccagtcagagtgttagcggcaacttagcctggtaccagcagaacgccgtggccagacctcccgaggcctccttatccagtggtgcactcccaccgacgggccagtcggtaactccccagcccgtaggttccaggtcggacgtaggttggggtctggggacaggtacgttcactctacaccatccagcacgtcctgactagtcgtagtaagttattttgacttagtttattactgttacagtactaagttataagtaacgtcggacgtggtaccgttcggacgaaggaacgaggtagaatacgaaacgtacgtagacggtacgtacgacgactacgttcgtcgttacttctactcccg

SEQ ID NO: 262148 - DNA, 694 bp, Homo sapiens
  misc_feature: GYAE6OF02ISRMH.2.26.C04.1.454.CMB.1.raw
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagacgccaccctctcctgcagggccagtcagagtgttagcgcaattgcctggtaccagcagaagcctggccagacctcccgaggcctaccttactccatggtcgcactccaccagggcccacgttggactcccagcctaggttcaggtggcaggtcgggtctgggacaggtacgttcaactctcacagtcagcacgcctgacctagtaccgtaggaaagttacgtttttagaccgttaagttttaacgtttacgtacgttacgaacggtaactaaggtttaaacttaaaaacggttaaccgttcgggggtacccgtttacgggggtaaccggtttaccggggaacccggtaaaacggggaacccgttaaaaggggttacgggaaaacgttaccggtaaaaaccggtaaacggtttacggtacgggttaccgtaacggaacccgtaaccctaaggttcccgtttaggttacccgtttaccgatttacccccgg

SEQ ID NO: 262149 - DNA, 649 bp, Homo sapiens
  misc_feature: GYAE6OF02JO9P2.2.26.C04.1.454.CMB.1.raw
  modified_base (206)..(206): a, c, t, g, unknown or other
  misc_feature (206)..(206): n is a, c, g, or t
  modified_base (410)..(410): a, c, t, g, unknown or other
  misc_feature (410)..(410): n is a, c, g, or t
tcagacgctcgacacacgaccggtgctcgatttagtctagcgactttgggtttgggggtagggaacgtgctcagttaggacccagacggaaccatggaagccccagcgcagcttctcttcctcctgctactctggctcccagataccactggagaaatagtgctgacgcagtctccagccaccctgtctgtgtctccaggggaaanagccacctctcctgcagggccagtcagagtgttagcggcaacttagcctggtaccagccaggaagccgtggccaagactcccaggccttacctatccagtggtgcactccgaaccgagggccctacgtggtactcccagccctaggttcaggtcggacaggttgggactggggaacaggtacggttccaacgtcctcgaacctnttacgagcgacgcctcggacctacgttacctaggaacgttattttcgaccgttaagttttacgttacttcgtctaacggtactaaggttaataaacgttaacgtgggtaccgtacggtacgggtttccgaccggtaaacgggtaaccgtaaagggttacgtaagttaaccgaaacggtacgttaggtacggtactacggtacaccgtaagttccgttacgtaccgtttacgacttcccg

SEQ ID NO: 262150 - DNA, 540 bp, Homo sapiens
  misc_feature: GYAE6OF02HP9VD.2.26.C04.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaanagccaccctctcctgcagggccagtcagagtgttagcggcaacttagcctggtaccagcagaagcctggccagactcccaggctccttatccatggtgcatccaccagggccactggtactcccagccaggttcagtggcagtgggtctgggacaggagttcactctcaccatcagcacgcctgcagtctgaagtntttgctagtttacttactgtcagtctaagtataataacgtggccgtggtacgttcggaccgaaaggaaccgtaagggtaggaactacgaaaaccggtaacgtggtacggctacgccactacttccgtagtcttcacttcccg

SEQ ID NO: 262151 - DNA, 823 bp, Homo sapiens
  misc_feature: GYAE6OF02F4NY1.2.26.C04.1.454.CMB.1.raw
  modified_base (214)..(214): a, c, t, g, unknown or other
  misc_feature (214)..(214): n is a, c, g, or t
tcagacgctcgacacacgaccggtgctcgatttagtctagcgactttgggtttgggggtagggaactgctccaggttaggacccagacggaacctatggaagtccccagcgcagcttctcttcctcctgctactctggctcccagataccactgggagaaatagtgcgttgacgcagttcttaccgagtccacctgtctgtgtctcgagggaanagccgacctctctgcagggccagtcagagtgttagcgctaacttagcctggtaccagcagtacgcctggaccagacctcccgaggtccttccgttactcccaagttcgggtaggccgactcccgaaccgaggggtcccaacgttcggttaaccttccccgagtccccgtacggttccacggttcggcctacgggttcgggttccttaccggggactacggtaccgtttccaccgtttccgtaccgaacctacgtaccgacggacaacggcccttagggaccgtaacgggttccttacgggtaaacgttacgtttttacggaccggtttaacggtttttaacgttacccgtttacgttacccgtaacggttaccgtaacggtttaactttaaacggttaaccggttccgggggtacccgggtttacggggtaacccggggttttaccgggaaacccggtaaaccggggtaacccgtaaacggggtttaacgggaaaccgttaccgaaaaccgggttaaccggtacgggttaacggggtcccttaacgggtaccctaacccggtactttacccggttacggtttacctttacccggtacgtttacccccgg

SEQ ID NO: 262152 - DNA, 562 bp, Homo sapiens
  misc_feature: GYAE6OF02GJHMZ.2.26.C04.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
  modified_base (558)..(558): a, c, t, g, unknown or other
  misc_feature (558)..(558): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtgcactccaccagggccactggtactcccagccaggttcagtgcagtggtctgggacagtnttcactctcaccatcgagcagtctcgcaacctgaagtatttgactaacttacttactcgtacaactagtacgttacacgtaccccgtacggaccgtttaccggaccgtaacgggaaccgtaacgggtacggaaacgtacgaaacgtacgtaggtacggcgtacgacaaccgtactacgtctcttctactccgttcccnctac

SEQ ID NO: 262153 - DNA, 783 bp, Homo sapiens
  misc_feature: GYAE6OF02J1KGS.2.26.C04.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
tcagacgctcgacacacgaccggtgctcgatttagtctagcgactttgggtttgggggagggaacgtgctcagttaggacccagacggaaccatggaagccccagcgcagcttctcttcctcctgctactctggctcccagataccactggagaaatagtgctgacgcagtctccagccaccctgtctgtgtctccaggggaaancgccacctctccngcagggccagtcagagtgttagcggcaacttagccctggtaccagcagaagccgtggccagactcccgaggcctccttatccagttcgggtgcctaactcccgaaccgtacggggcctaccgttacgggtaactcccccaggtaccccgtaagggtttccaagggtcggtaccgtagggtttcgggggtaccgttgggggaacccagggttaacggttcctaacgttccgttcaaacccaagtttccgaagtcccgtaacggcccttaggccgtaacggttcgtacggtaaacggttacgtttttacggtaccgttaagtttttacgttaaccgttcggtactacggtaacgtaacgtttaaacgttaaacttaaaccggttacgggtcccgggttaagggttacccgggttaaccggtacccggtaaaggggtaaaccctaagggggttaacggtaaacttaaccggtaaaaccgggtaacgttaacgggttacggttaaccgcggttaaccgaaccccgttaggtaccgtttacggttaccgtttaccgtacgtttacccccg

SEQ ID NO: 262154 - DNA, 729 bp, Homo sapiens
  misc_feature: GYAE6OF02JPHT7.2.26.C04.1.454.CMB.1.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (478)..(478): a, c, t, g, unknown or other
  misc_feature (478)..(478): n is a, c, g, or t
tcagacgctcgacacacgaccggtgctcgatttagtctagcgactttgggtttgggggtagggaacgtgctcagttaggacccagacggaaccatggaagcccagcgcagcttctcttcctcctgctactctggctcccagactaccactggagaaatagtgctgacgcagtctccagcccaccctgtctgtctctccgaggggaagacgccaccctctcctgcagggccnggtcngatggttagcggcaacgttagcctggtaccagcagacgcccgtggcccagtacctcccgaacgggtccttacccttaagtcccaggttcgggtcaacctacttcccgaacccgacggggcccaacgttggtactcccccgaggtaccctagggtttcaacgggtcggacgtcgggttaggggtccctagggggaccaaaggttcgttccgaactttccgtaccaccctagtccaagcgtacnccgtgctacggtctaaggtaagttagtttcgacgttatttagttacttacggtacacggtacaggttttaaactaacgttaacgtccggggtaccgggtttaacgggacccgggtttaccgggtaacccgggaaacgggtaaccggtaacgggtttaacgggtaacgtaacggaaaccggtaacggttacggttcggaacgttccggacctaccgtaacgttccgttacggttccttacgctttaccccgg

SEQ ID NO: 262155 - DNA, 551 bp, Homo sapiens
  misc_feature: GYAE6OF02FS8B1.2.26.C04.1.454.CMB.1.raw
  modified_base (293)..(293): a, c, t, g, unknown or other
  misc_feature (293)..(293): n is a, c, g, or t
tcagacgctcgacacacgaccggtgctcgatttagtctagcgactttgggtttgggggaggaactgctcagttaggacccagacggaaccatggaagccccgagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctcctanccatggtgcatccaccaggccactggtatcccagccaggttcagtggcagtgggctgggacagacgttcactctcaccatcagcagcctgcagtctgagtatttgctagtttatacttgtcagctagtataataacgtggccgttaggaccgttccggaccgaacgggaccgtaagggtacgtaacgtacgaaacggtaacgttaggtacggacgtacgaccgtacctacgtaccgtacgttacttacgtacttcccg

SEQ ID NO: 262156 - DNA, 560 bp, Homo sapiens
  misc_feature: GYAE6OF02IGXLC.2.26.C04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctctgctactctggctcccagataccactggagaaatagtgctgacgcagtctccagccaccctgtctgtgtctccgaggggaaangccacctctcctgcagggccagtcagagtgttagcggcaacttgcctggtaccagcagaacgcctggccagactcccaggctccttactccatggtncatcccacagggccactggtactcccgagccctaggttcaggtcggcctaggtcgggtctagggacagtacgttcacgttctcaccatcgagcacgcctgcgacgtcgtagtaagtattttgacttagtttaattactgtacagtctaagttaataagtaacgtcggaccgttaggtaccgttcgaccgtaaagggaccgtaagggtacgaatacgaaacgtaacgtgtaggtcgtagacacatcgtgtcttcacttccg

SEQ ID NO: 262157 - DNA, 534 bp, Homo sapiens
  misc_feature: GYAE6OF02JDAB7.2.26.C04.1.454.CMB.1.raw
  modified_base (204)..(204): a, c, t, g, unknown or other
  misc_feature (204)..(204): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (498)..(498): a, c, t, g, unknown or other
  misc_feature (498)..(498): n is a, c, g, or t
  modified_base (527)..(527): a, c, t, g, unknown or other
  misc_feature (527)..(527): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgttagcggcaattagcctggtaccagcagagcctggccagacncccagctcctatccatggtncatccacgagggccagtgtacnccagccaggttcaggtgctagtgggtctgggacaggtcttcacgtctacaccatcgagacacgtccctagctagtcgtagaagttattttcgacttagtttactactgtcagtctaagtaataataacgtggaccgtggacttcgacgaaggaccgaggtagaatacgaaacgagtagnggtactagcctacagttcctagtcttacnttacccg

SEQ ID NO: 262158 - DNA, 569 bp, Homo sapiens
  misc_feature: GYAE6OF02F0QK3.2.26.C04.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaanagccaccctctcctgcagggccagtcagagtgttagcggcaacttgcctggtaccngcagacgcctggccagactcccaggctccttanccatggtncatccacgagggccagtggtactcccagcctaggttcagtggcaggtgggtctgggacagtgttcactctacacctatcagcacgcctgctagtctagtagtatttgacttagtttacttacttgtacagtactagttaacttaactacgtcgggtaccggttgggtaccggttccggaccgtaaacgggtaaccgtaagggtagaactacgtaaacggtacgtaggtacggcgtcgaccgactacgtcttcgttcttcgtacttcccg

SEQ ID NO: 262159 - DNA, 614 bp, Homo sapiens
  misc_feature: GYAE6OF02I94GM.2.26.C04.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctcgaggggaangccaccctctcctgcagggccagtcagagtgttagcggcaacttagcctggtaccagcagaagcctggccagacctcccgaggccttccttatccagtggtcgcactcccgaccgagggcccacgtggtacctcccgagcctaggttcaggtggctaggtgggtcngggacaggtcgttcnctcaccacntcagcacgcctagctagtcgtagtaagttgttttcgactttaatttattacgttagtactagtacgtaagttaattaagtaaggtacgaacgtaaacggtaccggttaaccggaaccgtaaacgggaaccgaaggggttaacgtaacgtacgaaaacggtacgtacggtacggaccgttagaaccgtacgtattccgttcgttaccgttcctacgttccccg

SEQ ID NO: 262160 - DNA, 617 bp, Homo sapiens
  misc_feature: GYAE6OF02HH9E3.2.26.C04.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctntcctgcagggccagtcagagtgttagcggcaacttagcctggtaccagcagaagcctggccagactccaggctcctatccatggtncatccacaggccagtgactccagccagtcagtgcagtggtcgtgggacagagttcactctcaccatcancagcctgcagtctagaagtatttgactaagtttacttacgtagttaccagtacgtaagttaagttaaagttaacgtaggtacctaaaacggttaaccggtttccgggaaccgtaaacggggtaaacccggtaaggggttaacggtaaacgttaaccggtaaaaccgggtaaacgttcggtaacgggtaccgttacggaccgaacccgttaacgttccttacggttacctttaccgtactttaccccgg

SEQ ID NO: 262161 - DNA, 590 bp, Homo sapiens
  misc_feature: GYAE6OF02G4549.2.26.C04.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaangccaccctctcctgcagggccagtcagagtgtagcggcaattgcctggaccagcagaagcctggccagacctcccaggctcctatccagtggtcncactcccaccgaggccacgtggtactccagcctaggttcagtcggctaggtgggtctgggacaggacgtttcacttcgtaccacatcgagcacgcctgactagtctagaattatttgacttagtttacttactagtacagtactaagtaataagtacgtcggtaccgtacggtacgttaccggacgaaaggtaacccgaagggtacgtaaacgtacgtaaaaccggtacgttacggtacggtacgtacgactaaccgtacgttccgttagtttcctacgtaccttccccg

SEQ ID NO: 262162 - DNA, 617 bp, Homo sapiens
  misc_feature: GYAE6OF02FLCWS.2.26.C04.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (441)..(441): a, c, t, g, unknown or other
  misc_feature (441)..(441): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttagcctcggtaccagcagaagcctggccagacctccaggctccttancctagtggtgcactccaaccgagggccctactggtactccccagcccgtaggttcaggtcggactaggtcgggtcttggggactaggtacgttcaacctcttacaccatcgacgtccgaagccctgcgtacgttctagtaacgttntttagccttagttttattacgttgtcagtacgtaagttaattaaactaacggtcggtacggttacgggtaccggttacggaccggtaaacgggaccgaagggttaacggtaaactacgaaacggtaacgtggtacggcgtcgaacgactacgttcttagtccttacacctttcccg

SEQ ID NO: 262163 - DNA, 801 bp, Homo sapiens
  misc_feature: GYAE6OF02JUC9S.2.26.C04.1.454.CMB.1.raw
  modified_base (211)..(211): a, c, t, g, unknown or other
  misc_feature (211)..(211): n is a, c, g, or t
tcagacgctcgacacacgaccggtgctcgatttagtctagcgactttgggtttggggtaggaacgtgctcagttaggacccagacggaaccatggaagccccagcgcagcttctcttcctcctgctactctggcctcccagactaccactggaagaaatagtgctgacgcagtctccagccaccctgtctgtgtacctccgaaggggaaancgccctaccctctcctacgcgagggccaggtcaggtacgtgtagcgactaacgtttagcccgttggtaacccaggtcaaggaacgtcccgtaggacctacgaaccgtccccgaagggtcttacccgttaactcccgtaagtgggtacctaccgacttcccgaacccgacggggtcccaccgttagggtaaccctccccggacggtacccggtaacggtttccgagtaccgggtaccgtaacggggtttggggtaccgtacgggggtaacgaaggttacgttacccgacctttacccgtacgaaccctagttacccgacgacgacccgtctcgtaacgacggttacgtaacggtaacgttacgggtttactcgtttaaccgttttagtaccggttacgttacggaacttaccgtaagtttaacgttaaaacctaccggttcgggtacgttacgggtaccggtttacccgaacggtaaaccgggaagttaacgggtacgtaactaaccggtaaacggtacggttagggtcgtaacgtacgtaacccgttacgtacgttacgttaccgtttaccggtactacccgttaccccg

SEQ ID NO: 262164 - DNA, 727 bp, Homo sapiens
  misc_feature: GYAE6OF02HNSBT.2.26.C04.1.454.CMB.1.raw
  modified_base (206)..(206): a, c, t, g, unknown or other
  misc_feature (206)..(206): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctccgaggggaaagngcccaccctctcctgcgagggccagtcagagtgttagcggcaacttagcctggtaccagcagaagcctggccagacctcccgaggccttccttactccgagttggtcgcactcccgaccgacgggccacgttcggtactcccgagcccgtaggttcaggtggctaggtcgggtcgtggggaacaggtacgttccaccgttcctaccgaacctagttccgaacgccgtaacggtcccgttaggaccgtaacggttacgttaaggtaaacgtttgttttacggacgtttaaggtttttaaccttacgtacgttaccaaggttactaaagttaattaaacgttaacggttcgggtacccggttagggttaacccggttcgggaacccggtaaacgggtaacccgtaaaaggggttacggtaaaacgttaaccgtaaaacggtaacggtcggttacgggaaccgttacgaacccgtaaccgtacgttaccgttacgtttaccgtttacccgtacgtttacccccg

SEQ ID NO: 262165 - DNA, 673 bp, Homo sapiens
  misc_feature: GYAE6OF02JEL34.2.26.C04.1.454.CMB.1.raw
  modified_base (326)..(326): a, c, t, g, unknown or other
  misc_feature (326)..(326): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtcctccagccaccctgtctgtgtctccgaggggaaagacgcccaccctctcctgccagggccagtcagacgtgttagcggcaacttacgccgtggtaccagcaagaacgcctcggaccacgacctcccgaggtccttccttactcccgtagtgggtcnctaactcccgaaccgtacgggcccacgttacgggtacctccccgaacgtccgtaaggttcacggtcggactagggttcgggtcgtagggactacggtacgttccacgttccgtacctaaccgtgtaaccgacggtacccgacggtcccgtgtacccgtagtaccgtaaggtaaacgttacgttttcgacgtttaagtttactttacgtcgtacagtacgtattaataacgtacgtcggtacgtaggtaccgtcggtaccgaacggtacgtaaggtaagaactacgtaaacggtcgtaggtacggcgtacgactaccgtacgttcgcgtttactacgtaccttacccg

SEQ ID NO: 262166 - DNA, 538 bp, Homo sapiens
  misc_feature: GYAE6OF02GEJUC.2.26.C04.1.454.CMB.1.raw
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctctcctgcagggccagtcagagtgttagcggcaacttagcctggtaccagcagaagcctggccagactcccaggctccttatccatggtcgcatcccaccgagggccacgtggtactcccgagccaggttcagtggctaggtgggtctgggacaggcgttcactctcaccatcagcagcctgcagtctagaatatttgctagtttattactgtcagctagttaataagtacgtggtccgtgggtaccgttcggacaaagggaccaagggtagaactacgaaacggtagtaggtacggctagaccaccgattcgtgtcttacattcccg

SEQ ID NO: 262167 - DNA, 558 bp, Homo sapiens
  misc_feature: GYAE6OF02FYVKX.2.26.C04.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (294)..(294): a, c, t, g, unknown or other
  misc_feature (294)..(294): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctntcctgcagggccagtcagagtgttagcggcaacttagcctggtaccagcagaagcctggccagactcccaggcctccttanccagtggtgcatcccaccaggggccacgtggtactcccagcctaggttcagtggcaggtgggtctggggacaggagttcactcaccaccatcagcaagcctgctagtctagtaagtattttgcttagttttatacttgtacagtctagtaataataacgtgaccgtggtacgttcggacgaacgggtacgaagggtaggaactacgaaacggtaagtaggtacggtacgtagtaccacgtactccgtagttcttacattccccg

SEQ ID NO: 262168 - DNA, 705 bp, Homo sapiens
  misc_feature: GYAE6OF02IP2KY.2.26.C04.1.454.CMB.1.raw
  modified_base (207)..(207): a, c, t, g, unknown or other
  misc_feature (207)..(207): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtcgtctccgaaggggaaanacgcccaccctctcctgcgagggccagtcagtagtgtagcggctaacttagcctaggtaccagcaagaacgcctaggccagacctcccgaggtccttccttaactccagttcggtcgactactcccgaaccgtacgggcctaacgttcggtaacctccccgaagtcccgtaggttccaggtcggacgtaggtcgggtcgtgggactaggtacgttcactctaccacctagtcgagcacgccgtcgacgtagtacgtagtaagttcttttcgactttagtttacttacgtgtacgagtacgtattaagtaacgtaacgtcgggtaccgttacgggtaccgggttaccggaacccggtaaacgggtaaccgtaaaggggtaacggtaaaccgttaaccggtaaaccggtaacgttcgggtacggtaccgttaaccggtacccgttaaccggtacgtttaccggttaccggtttaccgttaccgttaaccgtttcccccgg

SEQ ID NO: 262169 - DNA, 626 bp, Homo sapiens
  misc_feature: GYAE6OF02GKDN7.2.26.C04.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggccttccttatccagtggtgcacgtccaccgacgggccacgtcggtactcccgagcctaggttcaggttcggctaggtgggtcgtagggacaggtagttcactctcacactacagcacgcctgcagtctagaatntttacgactaatttacttacttcgtactagactaaggttaataagttaacggtacggtaaccgtaaacgtaccggtttaccggaaccgtaaacggggtaacccgtaagggggttaacgtaaacgttaaccgtaaacggtaaacgttcggtaacgggtacgtacgaccgtaccgtaacgttcgtacgtttaccttacgtacgttcccg

SEQ ID NO: 262170 - DNA, 544 bp, Homo sapiens
  misc_feature: GYAE6OF02FOCT6.2.26.C04.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgttagcggcaacttagcctggtaccagcagaagcctggccagactcccagctccttatccatggtncatccacgagggccacgtgtatcccagccaggttcagtgcaggtggtctgggacaggtacgttcacttctacacatcagcagcctgcagtctagaagtatttcgctagtttattacttgtctagctaagtaataataacgtcggaccgtggtacgttcggaccgaaagggaccaagggtagaagtaccgaaacgtaacgtaggtacggctacgaccgactactcgttgtacttacacttcccg

SEQ ID NO: 262171 - DNA, 691 bp, Homo sapiens
  misc_feature: GYAE6OF02HCUG8.2.26.C04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccaccctctcctgcagggccagtcagagtgttagcggcaacttagcctggtaccagcagaagcctggccagcctcccgaggcttccttatccagtggtncactcccaaccgagggcccacgtggtactcccgagtccgtaggttcaggtcggcgtaggttggggtcctaggggacaggtacgtttcaaccgttctaccgaaccctatcgaacgccgtacgccgtagccgtacgtcgtagtaagttagttttacgacgttaagttttacgttacgttgtacctacgtacctaagttaaactaagtttaaaccggtcgggtaccgggttacgggttacccgggtttaccgggaacccggtaaacggggtaacccgtaaaggggttaaccggtaaacgttaaccggtaaaccggtaaccggttggtaacggtacgtacggacctaaccgtacgttaccgttagtttacctttaccgttacgttaccccg

SEQ ID NO: 262172 - DNA, 702 bp, Homo sapiens
  misc_feature: GYAE6OF02HV00Z.2.26.C04.1.454.CMB.1.raw
  modified_base (203)..(203): a, c, t, g, unknown or other
  misc_feature (203)..(203): n is a, c, g, or t
  modified_base (350)..(350): a, c, t, g, unknown or other
  misc_feature (350)..(350): n is a, c, g, or t
tcagacgctcgacacacgaccggtgctcgatttagtctagcgactttgggtttgggggtaggaacgtgctcagttaggaccagacggaaccatggaagcccagcgcagcttctcttcctcctgctactctggctcccagactaccactggagaaatagtgctgacgcagtctccagccacctgtctgtgtctccgagggaaancgccaaccgtctacctgcgacgggcagtcaggtgtgttacgcggactaaacgttgccgtaggtacagacgagaacgcgtggacacgactccgaggtcctctataccagtggtcgcactacccgacgtacggcctactagggtaaccncccgtagacccgttaagggttcaaggtcggtaatcgggttgggtaccgtaaggggaacaggttaccgtttcgaactttccaccgtacgacgttacgaacgtacgaacgtccgtacgccgtaacgtcgttaacggtaaacgttacgtttacggttacgttaaacgttttacttttaaccggtacgtttaccaaggtaaccgttaagtaaacgttaacgttaaacggttcgtacccggttaggtacccggttacgaaccgaaacggtaaacgtaacgggtaagaacttaacggaaacgtacgtagggttcgtacgacggtacacgtacgtacgttcggtcttacgtcttacccg

SEQ ID NO: 262173 - DNA, 605 bp, Homo sapiens
  misc_feature: GYAE6OF02G4LJ0.2.26.C04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (298)..(298): a, c, t, g, unknown or other
  misc_feature (298)..(298): n is a, c, g, or t
  modified_base (427)..(427): a, c, t, g, unknown or other
  misc_feature (427)..(427): n is a, c, g, or t
  modified_base (598)..(598): a, c, t, g, unknown or other
  misc_feature (598)..(598): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaangccaccctntcctgcagggccagtcagagtgtagcggcaacttgcctggtaccagcagaagcctggccagactcccaggctccttatccatggtncactccgaccagggcccacgttggactcccgagccgtacggttcaggtcggcaggtcgggtcgtgggacaggtacgttcactctacacctataccgacgcacgccgttagctagttcgtaggaaagttnttttcgacgttaagttttacgttacttcgtacgtagtactaaagttaattaaacgttaacgttcgggtaccgttagggtaccggtttccggaaccggaaggtaaccgaagggttacgaactacgaacggtaagtggtacggactcgacctacgtattcctcgttacttacncttcccg

SEQ ID NO: 262174 - DNA, 720 bp, Homo sapiens
  misc_feature: GYAE6OF02FZZPH.2.26.C04.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaangccacctctcctgcagggccagtcagagtgttagcggcaacttacgcctggtaccagcaagaacgcctggaccagacctcccgaggtcctaccgttancctagttcgggtgacctatcccgacgacgggcctacgtggtactcccgagtccgtaggttcaggtcgcaggttgggtcgtagggacaggtagttccacgtcctaccaacgtactcgacgtccgaacgtcccgtcggacctcggttactacggtaacgtttagttttacggtctttaagttttaacgttaccgtttggtaccgtagttaaccgtaaagtttaaacttaaacgttaaccggttcgggtaccgggtttacgggtaaccggtttaccggggaaacccggtaaacggggtaaaccgttaaagggggttaacggtaaacttaaaccggtaaaccgtaacggttcggtaacggtaccgttaacgtacccggaacgtacttaccgtttagttcccgtttactaccgtttaccccgg

SEQ ID NO: 262175 - DNA, 878 bp, Homo sapiens
  misc_feature: GYAE6OF02JUDYT.2.26.C04.1.454.CMB.1.raw
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctggtctgngtctaccgaggggtaaanacgccacctcctcctgcacgggccagtcaggtagtcggttaagccggactaacgttacgcctaggaaccctagacgaacgaacggcccgttgggaccaaggtacctaccccggagggtacccttccttaacgtcccagttcgggtcacctaacgtccccgaaccgtaaccggggtaccctaccggttagggtaaccccttaccccggaaccgtccccggttaaaggggttccctaaggggttccgggtaccctaaagggggttttccggggttaacccggaggggggtaacctaaacgggttaccgtttaccgtaacccggtttacccgtaacccctaacccgggtaaatttacccggaacggtaacccggtaaccggtccccgtttaacgggcccggtaaacggttccggtaaacgggtaaaaccgtttggttttaacggtaccgtttaaacggtttttaacgttaccggtttacggtaacccgtaggttaacctaaacggttaaacgttaaacggtttaaccggtacgggtaccgggttaagggtaccgggtttaccggaacggtaacgggtaaaccgtaggttaaacgacgttaacgaaacggtaacttaggtacggaccgtacgtacccgacgttatacccgtagtttcgtacctaactttccccgg

SEQ ID NO: 262176 - DNA, 688 bp, Homo sapiens
  misc_feature: GYAE6OF02JGONN.2.26.C04.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (397)..(397): a, c, t, g, unknown or other
  misc_feature (397)..(397): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctccagataccactggagaaatagtgctgacgcagtctccagccaccctgtctgtcgtctaccgaggggaaaanagcccaccctctcctgcagggccagtcagagtgttagcggcaacttagcctaggtaccagcaagaagcctggccagacctcccaggctctanccatggngcatccaccgacgggccacgtcggtactcccgagccctaggttccaggtggcaggtgggtctcgggacaggtacgttcactcgtaccacctntacgagactacgcccgtgccaggttaccgtaggtaaacgttattttcggacgttttaacgtttaagtttacttcggttacgaacgtaccgtaaagttaacttaaaagttaaccgttacggggtcccggtttagggtaaccgggtttcccggtaacccggttaaaggggaaaccggttaacgggtaagggtaaaccgtaacggtaaaaccggtaacggttacggtacgggtaccgtacggtaccaaccgttaactccggtttaagttcccgtttacgtccgtttaaccccgg

SEQ ID NO: 262177 - DNA, 548 bp, Homo sapiens
  misc_feature: GYAE6OF02F0R5S.2.26.C04.1.454.CMB.1.raw
  modified_base (203)..(203): a, c, t, g, unknown or other
  misc_feature (203)..(203): n is a, c, g, or t
  modified_base (373)..(374): a, c, t, g, unknown or other
  misc_feature (373)..(374): n is a, c, g, or t
  modified_base (377)..(377): a, c, t, g, unknown or other
  misc_feature (377)..(377): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagcctccaggctccttatccatggtgcatcccacgagggccactggtactcccgagtccagttcagtgcaggtggtctgggacagagttcactctcacnncancacgctgcgacgtctagaagtagtttgactagtttatacttgtcagtctattaataactacgtggtaccgtggtacgttcggaaccgaagggaccgaagggtacggaaataccgaaaacggtacgtagtacgggctacgacaaccgtatccttgttcttacgtacttcccg

SEQ ID NO: 262178 - DNA, 670 bp, Homo sapiens
  misc_feature: GYAE6OF02G78NK.2.26.C04.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaanagcccaccctctcctgcagggccagtcagtagtgttagcggcaacttagcctggtaccaggcagaagcctggccagacctccgacggcctaccttatcccatggtcnctactccaccgaggccacgtgactccccgagtaccgaggttcaggtcggacgtagggttcgggtcgtagggacaggtacgttcaaccgttctccgactactccgaacgtcaacggtccctggtacctaggttacctaggaaacgtttcgttttagaccgtttaagtttaccttttaacgtcgttacgaacggttataaacggttattaaacgttaaccggtcgggttacccgtacgggttaccggtttaccgggaaccggtaaacgggaccgttaaagggtacgtaaacgtaaccaaacggtacgttggaaccggtcgtacaccggtacctactaacgttgtaccttagaccctttcccg

SEQ ID NO: 262179 - DNA, 540 bp, Homo sapiens
  misc_feature: GYAE6OF02FGOM0.2.26.C04.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagacgctcgacacacgaccggtgctcgatttagtctagcgactttgggtttgggggaggaactgctcagtttaggacccagacggaaccactggaagccccagcgcagcttctcttcctcctgctactctggctcccagataccactggagaaatagtgctgacgcagtctccagccaccctgtctgtgtctccaggggaaangccacctctcctgcagggccagtcagagtgtagcggcaacttagcctggtaccagcagaagcctggccagactcccaggcctccgttanccatggtgcactcccaccagggccacgtggtactccccagcccaggttcagtcggctaggtgggtctggggacaggtagttcaactctcgactatcagctagcctgcagtcngaagtatttgntagtttatacgtgtcagtnagttataatactggtacgtggtacgttcgccgaaggcgaaggtggaactcgaaacgtaacgtggtacggtactgacctacgacttaccgtgtcttcacgttccc

SEQ ID NO: 262180 - DNA, 661 bp, Homo sapiens
  misc_feature: GYAE6OF02HKEW9.2.26.C04.1.454.CMB.1.raw
  modified_base (215)..(215): a, c, t, g, unknown or other
  misc_feature (215)..(215): n is a, c, g, or t
tcagacgctcgacacacgaccggtgctcgatttagtctagcgactttgggtttgggggtagggaactggctcagttaggacccagacggaaccatcggaagccccagcgcagcgttctcttcctcctgctactctggctcccagataccacgtggagaaatagtgctggtacgcagtctacctagcccaccctgtctgtgtctccgaggggaaangcccacccgtcgtccgtgcgagggccacggtcaggagtgttacgcggctaacgttgcctggtaccagcagaacgcctggccagcctcccgaggtcctaccttatccgagtggtcgcctacgtcccgaacgaggggcccaacgttcggtaactccccgagtccgtagggttaccaggtcgcgtaggtgggtctagggactaggtcgttcacgtcgtacaccatccgacgtcgacgtcctgaccgtacggtacgtagtaacgttagttttacgacgttaagttttactacgttgtacagtactaagtaataacttacgtcggtaccgttaggtaccgttacggaaccggaaacgggtaaccgtaacgggtacgtaacgtaacggtaacggtaacggtggtacgtcgtacgacctacgtattccgtcgtttacgtcctacgttaccccg

SEQ ID NO: 262181 - DNA, 669 bp, Homo sapiens
  misc_feature: GYAE6OF02F2DGM.2.26.C04.1.454.CMB.1.raw
  modified_base (204)..(204): a, c, t, g, unknown or other
  misc_feature (204)..(204): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaanagccaccctctcctgcagggccagtcagagtgtagcggcaactagcctggtaccagcaagagcctggccagacctcccgaggcctccttatccagtcggtgcctatcccgaccgacgggccagtggtactcccaggccctaggttcaggtcggactagggtcgggtcgtaggggactaggtacgttcaccgttcctaccaacctagtcgaacgccgaacggtccctagaccgtaggttaccgtaaggtaacgttattttacggactttaaggttttaacttaccgtttaggtaccaacgttacgtaagttaacttaaagtaaccggttcgggtaccggttagggtaccggtttaccggaaccggtaaacggggtaaccgtaagggtaacgtaacgtaaccgtaaaccggtaacgtaggtacggacctcgacctacgtattccgtcgttacttactacgttccccg

SEQ ID NO: 262182 - DNA, 536 bp, Homo sapiens
  misc_feature: GYAE6OF02FID89.2.26.C04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctctcctgcagggccagtcagagtgttagcggcaacttagcctggtaccagcagaagcctggccagactcccaggctccttatccatggtncatccaccaggggccactggtactcccagcccaggttcagtcggcagtgggtctggggacagtagttcactctcaccatcagcagcctgccagtctgaagtattttgctagtttattacttgtcagtctagtataatactcgtcctcgtgaccgttcggaccgaacgggaccaaggtacggaaacgtacgaaaacgaacgtggtaggcctagccacctagttctcgttcttctac

SEQ ID NO: 262183 - DNA, 555 bp, Homo sapiens
  misc_feature: GYAE6OF02HKZDF.2.26.C04.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaanagccaccctntcctgcagggccagtcagagtgttagcggcaacttagcctggtaccagcagaagcctggcagactcccgagctccttatccatggtncatccacgagggccacgtggtactcccgagcctaggttcagtggcaggtggtcgtgggactagacgttcactctcacctatcagcacgtctgcagtctagatatttgcttagtttatacgtgtacngtacaagttactaagtacgtggtccgtggtaccgttcggaccgtaaaggaccgtaaggtacgaaacgttacgaaacggtacgtgtacggcttacggacacctacgtccttcgtacttactacttacccg

SEQ ID NO: 262184 - DNA, 765 bp, Homo sapiens
  misc_feature: GYAE6OF02H2YEK.2.26.C04.1.454.CMB.1.raw
  modified_base (208)..(208): a, c, t, g, unknown or other
  misc_feature (208)..(208): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagcccaccctgtctgtgtctaccgaaggggaaaanacgcccaccctctccctagccgaagggccagtcagagtcgttagcggacaacttagcctaggtaccagcaagaacgcctaggccagacctcccgaagggcctccttaatcccagtgggtnacaatcccaaccgagggcccaacgtggtaacnccccgaagtcccgaagggtttccaaggtcggacctaggggttcggggtctaggggaaacctaggtaagtttccaacctttcctaccgtaaaccctagtcccgaagacaaccggtccgtacgaccgaggttaccgtagtaaagggttaatttttcggacgttaaacggtttttaacgtttaaccgttagtcgtaacgtaccgtaagttaaacgttaaaagtttaaaccggtcggggtacccgttaagggtaccggtttaccgggtaacccgggtaaaaggggaaacccgtaaacggggtaaggtaaaacgtaaactaaaaccggaaacgttaacggttaccgggtagtacggaccgtaaccgttaaccgttcgtaaccgggttttctttacctaactttcccccgg

SEQ ID NO: 262185 - DNA, 787 bp, Homo sapiens
  misc_feature: GYAE6OF02JPOEW.2.26.C04.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (325)..(325): a, c, t, g, unknown or other
  misc_feature (325)..(325): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctgctcccagataccactgganaatagtgctgacgcagtctccagccacctgtctgtgctcgagggaaancnccgacctctctgcagggcctagtcagtacgtgttagccggtacaacgtttagccgtaggtaccaggtcaagtacggcctggacccgagaccttcccgaaggtccttccttaagtccagttcggcncgtactacccgacgtacgggacctacgttggtaaccctcccgaaggtccccgtaagggtttcaacgggtcgacgttaaggtcgggggttctacggggaactaggggtacttccgtaacctccgttaacccgaccctaagttccgaacggttacgaacgtcccgtaggacccgtagttacgtaacggtaaacggttaattttacgggtactttaacggtttagtttaccgtacggttaccaagttacaaacggtttaacgttaaacgttaccggttaacgggtaccgtttaacggggtaccgtttacccgggtaaaccgggtaaacccggggtaaccgggttaaacgggtacgggtaaacttaaccgggtaaaaccggtacccggtttaaggtacgggtaactacggtacctaaccggttaaccgttacgttacgggtttaccctttacggttaccttcccgg

SEQ ID NO: 262186 - DNA, 784 bp, Homo sapiens
  misc_feature: GYAE6OF02IPLFD.2.26.C04.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtcctccagccaccctgtctgtntctcgaggggaangcccacctctcctgcagggccagtcagtagttggttagcggactaacttagccttaggtaccagcaggaagccgtggcccaaggtaccctccaggtcctccttaactccagtggtacnctacgtccctaaccgacggggtccctacgttagggtacctaccccgagtacccgtaggttctacgggtggtccgagggtttcgggggtacttacgggggaacacggttacggttccaccgttcctacccgtaccttacgcgtaacgcgtaccggtccctacggtccgtacggttaccgtaggttaaacgttagttttacggaccgttttaagtttttaacgtttacgttacgtagtaacggtacgtaacgtttaacgttaaacgtttaacccgggtgggttacccggttaggggttaacccggtttaccgggaaacccgggtaaccggggaaacgtaacgggggttaaacgtaagtaacccgggtaaacgtacggttacgggttacgggtaacccgtaggtaacccgtaaccggttaacttcccggtttagtttacccggtttaccctaaccggtttcccccg

SEQ ID NO: 262187 - DNA, 661 bp, Homo sapiens
  misc_feature: GYAE6OF02FT8NM.2.26.C04.1.454.CMB.1.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (410)..(410): a, c, t, g, unknown or other
  misc_feature (410)..(410): n is a, c, g, or t
tcagacgctcgacacacgaccggtgctcgatttagtctagcgactttggggtttgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagagccaccctctcctgcagggccagtcagagtgttagcggacaacttagcctggtaccagcagaacgcctggccagactcccgaggcctccttanccatgggtcncactcccaccgagggcctacgtggtactcccaggtccgtaggttcaggtggactagggtcggggtctggggaacctaggtagttccactcctacacctacncgagcacgtcctgactacgtgtagaagttactttgacttagtttacttacgttacgtacagtctaagttaacttaaacgtaacgttcggggtacccggttagggttaccgggtttaccgggaaccggtaaacgggaaccggtaaaggggtaacggtaaacgtaaccggaaaacgtaaccggttgggtaacggtacgttacggtaacccacgtaacgtttccggtaccgtttacttcctacctttaccccgg

SEQ ID NO: 262188 - DNA, 721 bp, Homo sapiens
  misc_feature: GYAE6OF02HWG5T.2.26.C04.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagacgctcgacacacgaccggtgctcgatttagtctagcgactttgggtttgggggaggaactgctcagttagaccagacggaccatggaagcccagcgcagcttctccttcctcctgctactctggctccagataccatggaagaaatagtgctgacgcagtctccagcccacctgtctgtgtctcgaaggggaaacncgtccacctctccngcacgggcctaggtcagtagtggttacgcggactaacttagccttaggaccagacgaagtaacgccgtacggaccaacggtaacctcccgaggtcctttaccttaatcccaagttcggtactccaacgtacccgaccgtaacgggccctaaacggtttcgggtaaccacccggtaagtacccgagggtttaccaaaggggtcgtagacgggtttgggttcgtagggaactaaggtcgttacacttccggtaaccacaacttccggaagtaccacggtctacggaccgtagtacgtaagaaacgtttctttaggtactttaacgttttacgttacgtccgttcgaaagtacgtaaagtaaatttaacgtaacggtcggtacgggttacgtacggtttaaccgaaccggtaaagggaaccgttaaaggaagttaacgaacgttaacggaacttcggtaggtaccaggccctaacgtacgttaccgttagtacccttactacttacccg

SEQ ID NO: 262189 - DNA, 567 bp, Homo sapiens
  misc_feature: GYAE6OF02FQMIK.2.26.C04.1.454.CMB.1.raw
  modified_base (412)..(412): a, c, t, g, unknown or other
  misc_feature (412)..(412): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagacctcccaggctccttatccatggtgcatccaccagggccacgtggtactcccgagcccaggttcaggtcggcaggtgggtcgtgggacagtacgttcacgtctcacctatcacgcacgcctgctagtcagaagtntttgcttagtttaacttcgttgtacagtactagttataacttacgtcggtccgttggtaccgtttcggaaccgtaagggaaccgtaaggtacggtaactacgaaacggtcgtaggtcggtactgacctacgtcgttcctgttcttctacttcccg

SEQ ID NO: 262190 - DNA, 739 bp, Homo sapiens
  misc_feature: GYAE6OF02JWUER.2.26.C04.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
tcagacgctcgacacacgaccggtgctcgatttagtctagcgactttgggtttgggggagggaactgctcagttaggacccagacggaaccatggaagccccagcgcagcttctcttcctcctgctactctggctcccagataccactggaagaaatagtgctgacgcagtctccagcccaccctgtctgtgtctccgaggggaaancgcccaccctctcctgcgagggccagtcagagtgtagcggactaacttagcctggtaccagcagaacgcctggccagacctcccaggccttccttanccctagtcggtcacactcccacgacgggccacgtcgtaactccacgccgtagttcaggtggacgaggttcggggtcgtaccggggactaacgggttgttacccgacgtttaccgtacgaaaccccgttattacccggacgtccgtaaccggcccgtttacggacccgtaaggttcccgtaaagggtaaacgtttaacgtttttccgggaacctttaaggtttttacttaccggttaccggttacctaaggttacccttaagggtttaaaccttaaacggttacggttccgggtacccggggttacgtacccgggtttacgggaacccggtaaacgggtaaccgtaggggttaacgaacgtacggtaaacgtcggtacggttacggccgttaacacgttaacgtcttaaggttcttaccggttatcccggttaccc

SEQ ID NO: 262191 - DNA, 763 bp, Homo sapiens
  misc_feature: GYAE6OF02JMCWR.2.26.C04.1.454.CMB.1.raw
  modified_base (202)..(202): a, c, t, g, unknown or other
  misc_feature (202)..(202): n is a, c, g, or t
  modified_base (590)..(590): a, c, t, g, unknown or other
  misc_feature (590)..(590): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctccagccacctgtctgtgtctccgaggggaancgccaccctctcctgcgacgggccagtaccgaggtacgttagtacggccggacctaaacgttcggccgttacggtaaccagtacgaaggaacgtccttacgggaccaacggtaaccgtcccgaggtccttacccttaactccgtagttcgggtacaccttaccgtacccgaaccggaaccgggtcctaccgggttacggtaccctacccgaacggtccgttaacgggttccaagggtccggtaacggtacggggtttcgggccgtaaggggtacctaaggtttacggttacctaaccgtccttaacaaccgttacgacgtaaccgcgaaccgttaccgcgtaacgtagttaccgagttaagtttcgtacgtacttaggtttctaacgntacgacttagtaattaacgaacgttcgtacggtccggttaacggtacccgttacgggaaaccggttacggtaaacggtaaccgtaaagtacctaacggtaaacgtggttacggaccgttaacgaccggttaaccacggtttacctccggttatcccggttatacccgttcccg

SEQ ID NO: 262192 - DNA, 635 bp, Homo sapiens
  misc_feature: GYAE6OF02IEF0Z.2.26.C04.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatgtgctgacgcagtctcagccaccctgtctgtgtcctaccgaggggaaancgccctaccctctacccgtgccgagggccaggtcagtacgtgtagcggcaacttcgcctggaccagtcaagagcctggctagacctccaggtctcctatcatggtcanacctccacgcgggccacgttgacctcccaagtcccgacggttcaggtcgtactaggggtagggtccgttaggggacctaggtaacgttccgaccttaccgtaccgtacccgacgttcgaacncggacccgtacgttcggacctaaggttaccgtaggtaaacttagtttacggtacgttaattttaacgtcgttagtccgtactacggttaagtattaactaaccggtcggtaccgtacggtaccgtccggaaacgtaggaaccgaagtagaactacgaacgtgcttacggatacgacgactagtccttgaccttcagtcccg

SEQ ID NO: 262193 - DNA, 779 bp, Homo sapiens
  misc_feature: GYAE6OF02I4ZZS.2.26.C04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
tcagacgctcgacacacgaccggtgctcgatttagtctagcgactttgggtttgggggaggaactgctcagttaggacccagacggaaccatcggaagccccagcgcagcgttctcttcctcctgctactctggctcccagataccatggagaatagtgctgacgcagtctaccagccacctgtctgtgtctcgaggggaangccacctcnctgcacggcaggtcagtacgtgttacgcggctaacgttgcctaggtcccaggaccagaacgtccgtcggcctaacggacccttacccgaggtccttaccctttacgtcccgagttggggtacaccgtacgtacccggaacccggacggggtcccctaacggtttcggtaacctcccggtacggtaccgtaaagggtttcccaagggtcggtaccgtaaggggtttcgggttacgtaacgggtactaacggttaacggtccctaacgttccctacggaaaccctgtacgacgtaccgaaccgtccgttacgaccgtaccgttaggttacggaaagtttacttttaggaacctttaggttttaacttacgttcgtacgttaacgtacttaaagttaacgttaaacgttaacggttaccgggtacggtttaccggtaaccgggttacgggtaacccggaaacgggttaaccggtaaggtttaaacggaactaacgtaacgtaaacggttggtaaccggtactacgtacccgttacgtacttaccgttctttacgtaccgttaccttacccg

SEQ ID NO: 262194 - DNA, 735 bp, Homo sapiens
  misc_feature: GYAE6OF02FUVE9.2.26.C04.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctacttctggctcccagataccactggagaaatagtgctgacgcagtctccagccaccctgtctgtgtctccaggggaaangccaccctntcctgcagggccagtcagagtgtagcggacaacttagcctggtaccagcagagctggccagacctcccaggtctccttanccagtcggtncatcccacgtaggcctagtcggtactcccgagtccgtaaggttcaacgggtcggacgtagggtggggtttaccgacggggaacgtaaggttacggtttaccaacccgtttccgtaccaaaccctacggttaccaacggccgaacggtcccgttagaccttaacggttaccgttaggtaaaacgggtttactttttacggaaccgttttaagtttttaacctttacgttgtttaacgacggtacgttaacggttaagtttaaaccgtaaacgttcgggggtaccgtttacgggtaaccgtttaccgggaccgtaaaaggggacccgttaaaggggtagaaacggttaacctaaaccgggtaagttcggtacggtacgtacgtaccgtaaccgtaagttacccgttggtttacccttaccgttacgttaccccg

SEQ ID NO: 262195 - DNA, 795 bp, Homo sapiens
  misc_feature: GYAE6OF02I43Y5.2.26.C04.1.454.CMB.1.raw
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (355)..(355): a, c, t, g, unknown or other
  misc_feature (355)..(355): n is a, c, g, or t
  modified_base (782)..(782): a, c, t, g, unknown or other
  misc_feature (782)..(782): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatgtgctgacgcagtctccagccaccctgtcctggtntctccgaagggggaanacgcccacccgttctaccgtgccagggcccaggttccaggtagtggttacgcgggacctaaacgttggccttagggtaacccaagccgaaggaacgccctagggccctaaggaccttccccgaggtccttccttaatcccaatgggtcnctactcccgaacgagggccccattcggaactccccgagcccgtaggtcacggtggccgtaggtttcgggtaccagggggtaaccagggtacgtttacccgaactttaccgttacccgaaacccgtactcccggtaaacggtaccgtaaccggtccccgttaggtaccgtaaggtttacccgttaaggtaacggttaactttttcgaccgtttaaccggtttttaatttaaccgttggttcctaagggtaccaaggtttaaactaacgttaaacgtcgggttaccgttaacgggttaccgtttaccgggaccgtaaacgggtaacccgtaaaggtaacgggttaaagtaccgtaaaaaccgggtacgttaacgggtacgggtaccttacggaccgtaacccgtaagttccgttccggttactttaccncccgtttaacccg

SEQ ID NO: 262196 - DNA, 804 bp, Homo sapiens
  misc_feature: GYAE6OF02F5M3I.2.26.C04.1.454.CMB.1.raw
  modified_base (205)..(205): a, c, t, g, unknown or other
  misc_feature (205)..(205): n is a, c, g, or t
tcagacgctcgacacacgaccggtgctcgatttagtctagcgactttgggtttgggggaggaactgctcagttaggacccagacggaaccatggaagccccagcgcagcttctcttcctcctgactactctggctcccagataccactggagaaatagtgctgacgcagtctccagccaccctgtctgtgtctccgaggggaaangcccaccctctcctgcacgggtccagtccgagtagtgttagcgacaaacttagcctaggtaaccagcagaacgcctggaccagacctcccgaggtccttccttaatcctaagtcggggtcactactacccgaaccgagggcctaacgtaggtaacctcccgaacgtccgtaaggttaccaggtcggacagggttcgggtactacggggaactaacggtagtttaccactttcctaccgaacctagtaccgaggccgtaacgtcccgtagaccgtaagttccgtaagtaaaggttacttttacggtacgttaacggtttttaactaaccgtttagtaacccgttaaggtaactttaacgggttaaaacttaaaggttaaacccgtaccgggggtaccggtttaagggtaaccccggttttaggggaaaccgtaaaacgggtaaacccggtaaagggttaaaccggaaacggtttaaaccgaaaaaccgggttaacgttaaccgggtaacggtaccgttaccggtaaaccgtaccccggttaaagttttaccccgttaacggttttacccgttttttaaccgttaccccgttaacccccgg

SEQ ID NO: 262197 - DNA, 740 bp, Homo sapiens
  misc_feature: GYAE6OF02H271Y.2.26.C04.1.454.CMB.1.raw
  modified_base (342)..(342): a, c, t, g, unknown or other
  misc_feature (342)..(342): n is a, c, g, or t
tcagacgctcgacacacgaccggtgctcgatttagtctagcgactttgggtttgggggaggaactgctcagttaggacccagacgggaaccatggaagccccagcgcagcttctcttcctctgctactctggctcccagactaccactggagaaatagtgctagacgcagtctaccagccctacctgtctgtcgtcctacggaaggggaaacgtacgccacctctccgtgcgacgggcaagtcacgtagtcgtacgcggctaacttagccgtagaccaggacgtagaacgtcgcggtaccaacgacctccggaggccttactactctacgtggtcacctacncccaacggacggccacgttggaacctccgacgtccggtaaggttcgaacgtcggcgttaacgggtcgggttacgtaggggaccgtaggttaccgtacgtaccgtacgtacgtaccgtattacggacgtacgtaccgtacgttcggtaacgtacgtcggttaaacgtaaagtttaccgttttacgtacggtttaaacgttttaaccgttacgttacggttaaccgtaaggtacgttaaacggtttaaacgtaaaaccggttaggtcccgggaacggtttcgggaaccggtttaccgggaacgtaacgggtaaaccggtagtaaacgtacgtaacggtaaccgtacgtaggtcgcgttaacgctaccgtaacttccgtacgtttaccgtactccttaccg

SEQ ID NO: 262198 - DNA, 855 bp, Homo sapiens
  misc_feature: GYAE6OF02IXITG.2.26.C04.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (827)..(827): a, c, t, g, unknown or other
  misc_feature (827)..(827): n is a, c, g, or t
tcagacgctcgacacacgaccggtgctcgatttagtctagcgactttgggtttgggggaggaactgctcagttaggacccagacggaaccatggaagccccagcgcagcttctcttccctcctgctactcgtggcctcccagactaccactggagaaattgtgactgacgcagtctccagccaccctgtctgtntccncgaaggggaaancgcccaccctcgtcctgcgaggccagtcagtagttgtagcggactaactcggcctggtaccngacgagacgtcccgtggaccgacgtaccgtcccgaggtcccttaccgttactaccagggtttcgggactccgttaccgaacccgaccggtaccgggtccctacgttaccgggttaaccgtccccaaggtccccgtaagggtttccaaacggttcggtaacccgttacggggttacggggtacccggtttaacggggaacacgggggttaacctttaacgaccccttttccgaaaccggtaaccccttacgggttacccgaaaccgttcggtaacccgttacccggtaccgtacgtaaccgggttacttaacggttaacgtttaccggttttaccggtaacctttaaacgggtttttacttaaccgttggttaacccgaagtacgttaaggttaaaccttaaaccggttacggttaacccgggcggtttacgggttaacccgttccgggtaaaccggtaacgggttaaccggaagggttaaccgggttaacttaaacggtaaccggttacgtaccggtagggccgttaccggaccttaaccgtgttaacccggttntttacccgttaccgttaccgttccccgg

SEQ ID NO: 262199 - DNA, 714 bp, Homo sapiens
  misc_feature: GYAE6OF02HGSDW.2.26.C04.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagtgctgacgcagtctcgagccaccctgtctgtntctccgaggggaancgccacctctcctgcaggccagtcagtagtgttagcggactaacttagcctagtaaccagcaagaacgcctaggaccaaggacctcccgaaggtccttacccttaacgtcctaagtcgggtacacctactccccgaaccgaagggtaccctacgtagggtacctacccgagtccctaagggtttccaaggttcggacgacggttggggtcttaaggggactaacggtacgttcgaacttccgactaacctaactcgaacgcacgtccgtacgcgtaagttctaaggtaaacgttagttttacggacttaagttttaaactacgtagttacgacgtacgaagttaataaacgttaaccgtagggtacgttacgggtaacggtttccggaaaccggtaaacgggaaacgtaacgggtaacgtaaacgtaaccggtaaaaccgtaacggtaggtacggtacgtaaccgacctaaccgtacgttaccgttacttaccgttacttaccgttacccg

SEQ ID NO: 262200 - DNA, 779 bp, Homo sapiens
  misc_feature: GYAE6OF02GH9PT.2.26.C04.1.454.CMB.1.raw
tcagacgctcgacacacgaccggtgctcgatttagtctagcgactttgggtttgggggaggaactgctcagttaggacccagacggaaccatggaagccccagcgcagcttctcttcctcctgctactctggctcccagataccactggagaaatagttctagacgcagtctccagccaccctgtctgtgtcctccgaggggaaacgacgccctacctcctcctgcgaggccagtcagagtgtagcgacaacttcgccgtaggtaccgagactagaacgtcctcggccaacgacctccccgaaggtccttacccttacgtccctagttcgggtcaccgtacctccccggaacccggacgggtacccctacggttccgggttaacctccccgaacgggtcccgttagggttccgaaggtcggggtacgtaggggttcggggttccgacggggacttaaggtacgttcctaacgttcccaccaacctagtaccgcggtaccgtaccgtccgtacgacgtacggttacgtaggtaacgtttagtttacgttacgttaagttttacgttaccgtacggttacaggttaactaacggtttaataacgttaacgggtcggttaaccgggtcgggttacccgggttaaccggaccgggtaacgggtaacgtaaacgggtaacaaacggttaccgtaaacggtccggttaaggtccggtaccgtccggaacttaacccggttcttaccgttaccgttcctttacccgtacttacccccgttaacccg

SEQ ID NO: 262201 - DNA, 714 bp, Homo sapiens
  misc_feature: GYAE6OF02FNGT4.2.26.C04.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggcctcccagataccactggagaaatagtgctgacgcagtctccagccacctgtctgtntcctcgagggaancgccaccctctacctgcagggccagtcagtgtgtagcgtactaacttggcctaggtaccagcctaaggaacgcctaggaccctaaggaccctcccgaggtctccttanccctagtcggtncctacgtcccgacgacggccctacggtcgttaccncccgagcctaaggttccaaggttcggacctaggggtcgggtacgtacggggaactaggttaccgttccaaccgttctacccgaacgtaactccaggccgacgtacccgtgaccgtagttccgtaagtaacgtttagtttacgacgtttaaggtttaacttaccgttcgaactacgtacgtttaagtaacgtaaaccgttaccggtcggtaccggttacgtacccgggttaccggaaccggtaacgggaccgttaaggtaacggtaaccttaacgaacgggtaacttacgggtaacgtaccggtagtaccccgtaactacggtttaccgtcgtttaccgttaccgtaccgtttacccc

SEQ ID NO: 262202 - DNA, 683 bp, Homo sapiens
  misc_feature: GYAE6OF02G37KS.2.26.C04.1.454.CMB.1.raw
  modified_base (210)..(210): a, c, t, g, unknown or other
  misc_feature (210)..(210): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggcctcccagactaccactggaagaaatagtgctgacgcagtctccagcccaccctgtctgtcgtctccgaggggaaaancgcccaaccccttctccctgaccgacgggccacgtcagtacggtggttaacgcggactaaacttagcctaggtaccgagacgagaacgcctaggaccgagaccgtacccgaggccttaccttacgtaccctagtggtcgcgaactacccgaccggaccgggccacgtggtacctacccgtacgccgtaaggtcaaggtcgacgaggtgggtctaggggactaggtagttaccgtactcctacaacctacgtaccgacgtaccgacgtcctcggtactacgtcgtagtaacgttagtttacgtacgttagttttattacgttacgtactacgattaagtaattaaagtaacgtacggaactaacggtaacgttaccggaacggtaacggaacgtaggtaaggaactacggaaacggtacgtaaggtcgacgtacgaacgtacctacgttacgtcttacgttaccgtacttcccg

SEQ ID NO: 262203 - DNA, 781 bp, Homo sapiens
  misc_feature: GYAE6OF02HZISL.2.26.C04.1.454.CMB.1.raw
  modified_base (244)..(244): a, c, t, g, unknown or other
  misc_feature (244)..(244): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagacgctcgacacacgaccggtgctcgatttagtctagcgactttgggtttgggggagaactgctcagttaggacccagacggaaccatggaagcccccaagcgcagcttctcttcctcctgcctactctggcctcccagactacccacgtcgggaagaaaattcggtgctaggacgctagtcctacccgacgcccacccttgtaccgtggttcgtacccgtaccgggaagggggtaaaacnccggtaccccaccccgttcgtcccgtgaccgtacgggaccctagttacgaggtacgttggtaccggacgacttaaacgttgcccgttaaggtacccagtacgaacggtacgccgtacggaccaacgacctcccgaggtcctactactcgtagttgcgtactaccnccgaccgtacggacctacgtagtaccnccgtacgttacggtacgttacgagtcggtacgtggttcgggtacgagggtaacctggttaaccgtccgaccgttacacccggaacctagtccggaacgccgtaccggtcgtaccgtaccgtacggttcgtaaagttacgtttagtttcccgtaaagtttactttaacgtcgttagaccttggaaacttataaacgtacgttacgggtccggtaaggtccggttaccggaaccgttaaacgggacggtaaaacggacgggttaacaaaccgtacggtaaacgtcgtaccgggtactaacgaccgttaccggactttccgtctttaccgtacctctaccccgtaccg

SEQ ID NO: 262204 - DNA, 819 bp, Homo sapiens
  misc_feature: GYAE6OF02HN6K8.2.26.C04.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagacgctcgacacacgaccggtgctcgatttagtctagcgactttgggtttgggggaggaactgctcagttaggacccagacggaaccatggaagccccagcgcagcttctcttcctcctgctactctggctcccagataccactgganaaatagtgctgacgcagtctccagtccaccctgtctgtgtctccgaggggaaancgccaccctctcctgcgaggccagtcaggngtgttagcgactaacttgcctggtaccagcgagaacgccgtggaccacgtactccccgaggtccttaccgttaactacccgtagtcggggttacacccgtactacccgaaccgtacgggccccacgttaggtacccttacccgacgtacccgtagggttccaacggtcggtaccgagggtttacgggtcggtacgggacgtacggtacggtttaccacgttccgtacgaacccgtagtaacccgacgtaccgaaccggttccctacggacgtaaccgttaacgttaacgggtaaacggtttatttttcgggaaccgtttaaggtttttaaaccttttaacgggttcgttaaccgtaacggttaacctaaacggttaaacttaaaccgggttaacgtacccgggttaacgggttaccgggttaacggtttaacccgggaacggtaaacgggaaaccggttaacgggttaaaggaaaccgttaaaccggtaaaccggttaacgtacggttaacggtaccgtaccggtaacccgttaacgacccgttacgttttaacgtaccgtttacccggtattttaacccccgg

SEQ ID NO: 262205 - DNA, 694 bp, Homo sapiens
  misc_feature: GYAE6OF02IKCSN.2.26.C04.1.454.CMB.1.raw
  modified_base (149)..(149): a, c, t, g, unknown or other
  misc_feature (149)..(149): n is a, c, g, or t
tcagacgctcgacacacgaccggtgctcgatttagtctagcgactttgggtttgggggaggaactgctcagttaggacccagacggaaccatggaagcccagcgcagcttctcttcctctgctactctggctccagactaccactgganaaatgtgctgacgcacgtctccagccacctgtctgtcgtctcggaaggggaaagcgcctaccgtctaccgtgccgagggcctaacgtcgaggtaacggttagtacggccggtactaacgttaggtccgttggtaaaccctggtaccaagaacgctcggaccacgtactccgaggtccttaccttacgccagttggctacgactcccgaacgtcggcctacgtacgtcaccgcgtaccgtaggtcacggtcggacggtacggtgggtacgacgggtaacacggtacttcgtaactcttaccgacgactcgaaagcctacgtacctggactacggtcgtaagtaacggtttattcgggtacttaatttacgttcgtacgactaggtaactattaaacgtaacgttcgacggtcggtttacgacgggtttacgaaccgggtaaggaaaccggtaacgggaacgttaacaaaccggacgttaacggtcggaacgccgttaacgtacgtaacctcggttaacgtaccgtttactaccgttaccgttcccg

SEQ ID NO: 262206 - DNA, 783 bp, Homo sapiens
  misc_feature: GYAE6OF02IVFP5.2.26.C04.1.454.CMB.1.raw
  modified_base (189)..(189): a, c, t, g, unknown or other
  misc_feature (189)..(189): n is a, c, g, or t
tcagacgctcgacacacgaccggtgctcgatttagtctagcgactttggggtttggggggaggaactgctcagttaggaccccagacggaaccatggaagccccagcgcagcttctcttcctcctgctactctggctccagataccactggagaaatagtgctgacgcagtctccagccaccctgtctntgtctccgagggaaacgagcctaccctctcctgcgagggccagtccagagtggttacgcggactaacgtgaccgtacggtaaccagaccaaggtaacgccgtagggacccaacgtaccgtacccgacggtccttacccgttacttaccgagtcggtacgacctaccgtacccgaacccggtaacggggaccctaacgttacgggtaacctaccccgacggtacccggtaaggtttaccgaggtacggtaccggtaagggttccggggtacgtaggggtaaactaggttaacgttcctaacgttcccctaccgaaccgtaagttaccgaacggtacccgtaccggtaccccttgggaccctaaacgttacgttaaacgtaaagttactttttggtaacgtttaagtttttaacgtttacgttaggttaccaacgtacgtaatttaaacgtaaacgttaaacggtcggtaaccggttaacggtaccggttaccggtaacgaaacgggtacgtaaagggttacgaaacgtacgaaacggtacgtcggttagacgtacgtacctaacctacgttagttacgtcttacgtccttacccg

SEQ ID NO: 262207 - DNA, 191 bp, Homo sapiens
  misc_feature: GYAE6OF02HFL9U.2.26.C04.1.454.CMB.1.raw
  modified_base (144)..(144): a, c, t, g, unknown or other
  misc_feature (144)..(144): n is a, c, g, or t
  modified_base (153)..(191): a, c, t, g, unknown or other
  misc_feature (153)..(191): n is a, c, g, or t
tcagacgctcgacacacgaccggtgctcgatttagtctagcgactttgggtttgggggaggaactgctcagttaggacccagacggaaccatggagccccagcgcagcttctcttcctcctgctactctggctcccagataccncgtggaatnnnnnnnnnnnnnnnnnnnnnnnnnnnnnnnnnnnnnnn

SEQ ID NO: 262208 - DNA, 114 bp, Homo sapiens
  misc_feature: GYAE6OF01B8KJ2.51.73.G07.1.454.CMB.1.raw
  modified_base (114)..(114): a, c, t, g, unknown or other
  misc_feature (114)..(114): n is a, c, g, or t
tcagcgatcgtatacacgaccggtgctcgattagctctacgctctaaggaaggcagcgtcactctgttcccacctcctctcgtagcactctgagcggctggcaaggcgcatagn

SEQ ID NO: 262209 - DNA, 161 bp, Homo sapiens
  misc_feature: GYAE6OF01BAHL6.51.73.G07.1.454.CMB.1.raw
  modified_base (152)..(161): a, c, t, g, unknown or other
  misc_feature (152)..(161): n is a, c, g, or t
tcagcgatcgtatacacgaccggtgctcgatttagctctacgctcagggcgacgaccggtgctcgatttagagtgctacgaagggaagggcagcgtcactctgttcccacctcctctcgtagcactctgagcgggctggcaaggcgcatagnnnnnnnnnn

SEQ ID NO: 262210 - DNA, 154 bp, Homo sapiens
  misc_feature: GYAE6OF01DWJGA.51.73.G07.1.454.CMB.1.raw
  modified_base (150)..(154): a, c, t, g, unknown or other
  misc_feature (150)..(154): n is a, c, g, or t
tcagcgatcgtatacacgaccggtgctcgatttagctctacgctcagggcacgaccggtgctcgatttagagtgctacgaaggaagggcagcgtcactctgttcccgcctcctctcgtagcactctgagcgggctggcaaggcgcatagnnnnn

SEQ ID NO: 262211 - DNA, 152 bp, Homo sapiens
  misc_feature: GYAE6OF01APFY1.51.73.G07.1.454.CMB.1.raw
  modified_base (151)..(152): a, c, t, g, unknown or other
  misc_feature (151)..(152): n is a, c, g, or t
tcagcgatcgtatacacgaccggtgctcgatttagctctacgctcagggcacgaccggtgctcgatttagctgtgcgtcgaagggaaggcagcgtcactctgttcccgcctcctctcgtagcactctgagcgggctggcaaggcgcatagnn

SEQ ID NO: 262212 - DNA, 224 bp, Homo sapiens
  misc_feature: GYAE6OF01EQ0GX.51.73.G07.1.454.CMB.1.raw
  modified_base (190)..(224): a, c, t, g, unknown or other
  misc_feature (190)..(224): n is a, c, g, or t
tcagcgatcgtatacacgaccggtgctcgatttagctctacgctcagggcgacgaccggtgctcgatttagctctacgctcagggcacgaccggtgacctcgatttagctgtgcgtcgaagggaaggcagcgtcactctgttcccaccctcctctcgtagcactctgagcgggctggcaaggcgcatagnnnnnnnnnnnnnnnnnnnnnnnnnnnnnnnnnnn

SEQ ID NO: 262213 - DNA, 160 bp, Homo sapiens
  misc_feature: GYAE6OF01DLXN3.51.73.G07.1.454.CMB.1.raw
  modified_base (152)..(160): a, c, t, g, unknown or other
  misc_feature (152)..(160): n is a, c, g, or t
tcagcgatcgtatacacgaccggtgctcgatttagctctacgctcagggcacgaccggtgctcgatttagagtgctacgaagggaagggcagcgtcactctgttcccgccctcctctcgtagcactctgagcgggctggcaaggcgcatagnnnnnnnnn

SEQ ID NO: 262214 - DNA, 153 bp, Homo sapiens
  misc_feature: GYAE6OF01CHK92.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagagtgctacgaagggaagggcagcgtcactctgttcccaccctcctctcgtagcactctgagcgggctggcaaggcgcatagnn

SEQ ID NO: 262215 - DNA, 140 bp, Homo sapiens
  misc_feature: GYAE6OF01DRU6C.51.73.G07.1.454.CMB.1.raw
tcagcgatcgtatacacgaccggtgctcgatttagctctacgctcagggcacgaccggtgctcgatttatccacgcccagagctcgaaaacaccgcgccatctgatcgtagcactctgagcgggctggcaaggcgcatag

SEQ ID NO: 262216 - DNA, 151 bp, Homo sapiens
  misc_feature: GYAE6OF01C1Y76.51.73.G07.1.454.CMB.1.raw
  modified_base (151)..(151): a, c, t, g, unknown or other
  misc_feature (151)..(151): n is a, c, g, or t
tcagcgatcgtatacacgaccggtgctcgatttagctctacgctcagggcacgaccggtgctcgatttaggtgctacgaagggaagggcagcgtcactctgttcccaccctcctctcgtagcactctgagcgggctggcaaggcgcatagn

SEQ ID NO: 262217 - DNA, 152 bp, Homo sapiens
  misc_feature: GYAE6OF01DF69Z.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaagggcagcgtcactctgttcccaccctcctctcgtagcactctgagcgggctggcaaggcgcatagn

SEQ ID NO: 262218 - DNA, 153 bp, Homo sapiens
  misc_feature: GYAE6OF01C6T46.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagtctgacgtcaaagggaagggcagcgtcactctgttcccaccctcctctcgtagcactctgagcgggctggcaaggcgcatagn

SEQ ID NO: 262219 - DNA, 153 bp, Homo sapiens
  misc_feature: GYAE6OF01CBH70.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatagn

SEQ ID NO: 262220 - DNA, 153 bp, Homo sapiens; identical to SEQ ID NO: 262214
  misc_feature: GYAE6OF01B67SC.51.73.G07.1.454.CMB.1.raw
  modified_base (152)..(153): a, c, t, g, unknown or other
  misc_feature (152)..(153): n is a, c, g, or t

SEQ ID NO: 262221 - DNA, 152 bp, Homo sapiens
  misc_feature: GYAE6OF01DLGO1.51.73.G07.1.454.CMB.1.raw
  modified_base (151)..(152): a, c, t, g, unknown or other
  misc_feature (151)..(152): n is a, c, g, or t
tcagcgatcgtatacacgaccggtgctcgatttagctctacgctcagggcacgaccggtgctcgatttagctgtgcgtcgaagggaaggcagcgtcactctgttcccacctcctctcgtagcactctgagcgggctggcaaggcgcatagnn

SEQ ID NO: 262222 - DNA, 151 bp, Homo sapiens
  misc_feature: GYAE6OF01BTHDE.51.73.G07.1.454.CMB.1.raw
tcagcgatcgtatacacgaccggtgctcgatttagctctacgctcagggcacgaccggtgctcgatttagagtgctacgaagggaagggcagcgtcactctgttcccaccctcctctcgtagcactctgagcgggctggcaaggcgcatag

SEQ ID NO: 262223 - DNA, 291 bp, Homo sapiens
  misc_feature: GYAE6OF01BY1XM.51.73.G07.1.454.CMB.1.raw
  modified_base (287)..(291): a, c, t, g, unknown or other
  misc_feature (287)..(291): n is a, c, g, or t
tcagcgatcgtatacacgaccggtgctcgatttagctctacgctcagggcacgaccgtgctcgattagtagctcacgtattgggggcgaaagactgccctcgaccctttccgggtgcgcagcctgaggatgaggctgagtattactgcttgctcccctatagtggtgttcggtgttcggcggagggaccaagctgaccgtcctaggtcagcccaaggctgccccctcggtcactctgttcccgccatctgatcgtagcactctgagcgggctggcaaggcgcatagnnnnn

SEQ ID NO: 262224 - DNA, 153 bp, Homo sapiens; identical to SEQ ID NO: 262219
  misc_feature: GYAE6OF01APLJ4.51.73.G07.1.454.CMB.1.raw
  modified_base (153)..(153): a, c, t, g, unknown or other
  misc_feature (153)..(153): n is a, c, g, or t

SEQ ID NO: 262225 - DNA, 152 bp, Homo sapiens
  misc_feature: GYAE6OF01CSJSK.51.73.G07.1.454.CMB.1.raw
  modified_base (150)..(152): a, c, t, g, unknown or other
  misc_feature (150)..(152): n is a, c, g, or t
tcagcgatcgtatacacgaccggtgctcgatttagctctacgctcagggcacgaccggtgctcgatttagagtgctacgaaggaaggcagcgtcactctgttcccaccctcctctcgtagcactctgagcgggctggcaaggcgcatagnnn

SEQ ID NO: 262226 - DNA, 156 bp, Homo sapiens
  misc_feature: GYAE6OF01C7QZ2.51.73.G07.1.454.CMB.1.raw
  modified_base (152)..(156): a, c, t, g, unknown or other
  misc_feature (152)..(156): n is a, c, g, or t
tcagcgatcgtatacacgaccggtgctcgatttagctctacgctcagggcacgaccggtgctcgatttagagtgctacgaagggaagggcagcgtcactctgttcccaccctcctctcgtagcactctgagcgggctggcaaggcgcatagnnnnn

SEQ ID NO: 262227 - DNA, 161 bp, Homo sapiens
  misc_feature: GYAE6OF01DGIV6.51.73.G07.1.454.CMB.1.raw
  modified_base (153)..(161): a, c, t, g, unknown or other
  misc_feature (153)..(161): n is a, c, g, or t
tcagcgatcgtatacacgaccggtgctcgatttagctctacgctcagggcacgaccggtgctcgatttagagtgctacgaagggaagggccagcgtcactctgttcccaccctcctctcgtagcactctgagcgggctggcaaggcgcatagnnnnnnnnn

SEQ ID NO: 262228 - DNA, 187 bp, Homo sapiens
  misc_feature: GYAE6OF01DE1C7.51.73.G07.1.454.CMB.1.raw
  modified_base (154)..(187): a, c, t, g, unknown or other
  misc_feature (154)..(187): n is a, c, g, or t
tcagcgatcgtatacacgaccggtgctcgatttagctctacgctcgagggcacgaccggtgctcgatttagagtgctacgaagggaagggcagcgtcactctgttccccgccctcctctcgtagcactctgagcgggctggcaaggcgcatagnnnnnnnnnnnnnnnnnnnnnnnnnnnnnnnnnn

SEQ ID NO: 262229 - DNA, 155 bp, Homo sapiens
  misc_feature: GYAE6OF01EBVHB.51.73.G07.1.454.CMB.1.raw
  modified_base (153)..(155): a, c, t, g, unknown or other
  misc_feature (153)..(155): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnn

SEQ ID NO: 262230 - DNA, 160 bp, Homo sapiens
  misc_feature: GYAE6OF01BGSUF.51.73.G07.1.454.CMB.1.raw
  modified_base (153)..(160): a, c, t, g, unknown or other
  misc_feature (153)..(160): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnnnn

SEQ ID NO: 262231 - DNA, 154 bp, Homo sapiens
  misc_feature: GYAE6OF01BDTAS.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnn

SEQ ID NO: 262232 - DNA, 163 bp, Homo sapiens
  misc_feature: GYAE6OF01DS0WK.51.73.G07.1.454.CMB.1.raw
  modified_base (153)..(163): a, c, t, g, unknown or other
  misc_feature (153)..(163): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnnnnnnn

SEQ ID NO: 262233 - DNA, 153 bp, Homo sapiens
  misc_feature: GYAE6OF01ATI96.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagn

SEQ ID NO: 262234 - DNA, 160 bp, Homo sapiens
  misc_feature: GYAE6OF01EZQCD.51.73.G07.1.454.CMB.1.raw
  modified_base (141)..(160): a, c, t, g, unknown or other
  misc_feature (141)..(160): n is a, c, g, or t
tcagcgatcgtatacacgaccggtgctcgatttagctctacgctcagggcgacgaccggtgctcgagttatccacgcccagagctcgaaacaccgcgccatctgatccgtagcactctgagcggctggcaaggcgcatagnnnnnnnnnnnnnnnnnnnn

SEQ ID NO: 262235 - DNA, 177 bp, Homo sapiens
  misc_feature: GYAE6OF01AOW27.51.73.G07.1.454.CMB.1.raw
  modified_base (154)..(177): a, c, t, g, unknown or other
  misc_feature (154)..(177): n is a, c, g, or t
tcagcgatcgtatacacgaccggtgctcgatttagctctacgctcaggggcgacgaccggtgctcgatttagagtgctacgagggaaagggcagcgtcactctgttcccgccctcctctcgtagcactctgagcgggctggcaaggcgcatagnnnnnnnnnnnnnnnnnnnnnnnn

SEQ ID NO: 262236 - DNA, 153 bp, Homo sapiens; identical to SEQ ID NO: 262233
  misc_feature: GYAE6OF01ESTKB.51.73.G07.1.454.CMB.1.raw
  modified_base (153)..(153): a, c, t, g, unknown or other
  misc_feature (153)..(153): n is a, c, g, or t

SEQ ID NO: 262237 - DNA, 152 bp, Homo sapiens; identical to SEQ ID NO: 262217
  misc_feature: GYAE6OF01DD9IA.51.73.G07.1.454.CMB.1.raw
  modified_base (152)..(152): a, c, t, g, unknown or other
  misc_feature (152)..(152): n is a, c, g, or t

SEQ ID NO: 262238 - DNA, 152 bp, Homo sapiens; identical to SEQ ID NO: 262217
  misc_feature: GYAE6OF01B79F4.51.73.G07.1.454.CMB.1.raw
  modified_base (152)..(152): a, c, t, g, unknown or other
  misc_feature (152)..(152): n is a, c, g, or t

SEQ ID NO: 262239 - DNA, 139 bp, Homo sapiens
  misc_feature: GYAE6OF01DTV8J.51.73.G07.1.454.CMB.1.raw
tcagcgatcgtatacacgaccggtgctcgatttagctctacgctcagggcacgaccggtgctcgatttatccacgcccagagctcgaaacaccgcgccatctgatcgtagcactctgagcgggctggcaaggcgcatag

SEQ ID NO: 262240 - DNA, 154 bp, Homo sapiens; identical to SEQ ID NO: 262231
  misc_feature: GYAE6OF01BECNB.51.73.G07.1.454.CMB.1.raw
  modified_base (153)..(154): a, c, t, g, unknown or other
  misc_feature (153)..(154): n is a, c, g, or t

SEQ ID NO: 262241 - DNA, 161 bp, Homo sapiens
  misc_feature: GYAE6OF01BK18K.51.73.G07.1.454.CMB.1.raw
  modified_base (151)..(161): a, c, t, g, unknown or other
  misc_feature (151)..(161): n is a, c, g, or t
tcagcgatcgtatacacgaccggtgctcgatttagctctacgctcagggcgacgaccggtgctcgatttagagtgctacgaagggaaggcagcgtcactctgttcccacctcctctcgtagcactctgagcgggctggcaaggcgcatagnnnnnnnnnnn

SEQ ID NO: 262242 - DNA, 234 bp, Homo sapiens
  misc_feature: GYAE6OF01BTIWM.51.73.G07.1.454.CMB.1.raw
  modified_base (220)..(234): a, c, t, g, unknown or other
  misc_feature (220)..(234): n is a, c, g, or t
tcagcgatcgtatacacgaccggtgctcgatttagctctacgctcagggcgacgaccggtgctcgatttagctctacgctcagggcacgaccggtgctcgatttagctctacgctcaggcacgaccggtgctcgatttagagtgctacgaagggaaaggcagcgtcactctgttcccgcctcctctcgtagcactctgagcggctggcaaggcgcatagnnnnnnnnnnnnnnn

SEQ ID NO: 262243 - DNA, 153 bp, Homo sapiens; identical to SEQ ID NO: 262233
  misc_feature: GYAE6OF01B0NTV.51.73.G07.1.454.CMB.1.raw
  modified_base (153)..(153): a, c, t, g, unknown or other
  misc_feature (153)..(153): n is a, c, g, or t

SEQ ID NO: 262244 - DNA, 152 bp, Homo sapiens
  misc_feature: GYAE6OF01B50OB.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaagggcagcgtcactctgttcccgccctcctctcgtagcactctgagcgggctggcaaggcgcatagn

SEQ ID NO: 262245 - DNA, 158 bp, Homo sapiens
  misc_feature: GYAE6OF01AC5R7.51.73.G07.1.454.CMB.1.raw
  modified_base (152)..(158): a, c, t, g, unknown or other
  misc_feature (152)..(158): n is a, c, g, or t
tcagcgatcgtatacacgaccggtgctcgatttagctctacgctcagggcacgaccggtgctcgatttagagtgctacgaagggaagggcagcgtcactctgttcccaccctcctctcgtagcactctgagcgggctggcaaggcgcatagnnnnnnn

SEQ ID NO: 262246 - DNA, 152 bp, Homo sapiens
  misc_feature: GYAE6OF01EFBZA.51.73.G07.1.454.CMB.1.raw
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatag

SEQ ID NO: 262247 - DNA, 153 bp, Homo sapiens; identical to SEQ ID NO: 262219
  misc_feature: GYAE6OF01CQ89A.51.73.G07.1.454.CMB.1.raw
  modified_base (153)..(153): a, c, t, g, unknown or other
  misc_feature (153)..(153): n is a, c, g, or t

SEQ ID NO: 262248 - DNA, 157 bp, Homo sapiens
  misc_feature: GYAE6OF01CQ5MJ.51.73.G07.1.454.CMB.1.raw
  modified_base (152)..(157): a, c, t, g, unknown or other
  misc_feature (152)..(157): n is a, c, g, or t
tcagcgatcgtatacacgaccggtgctcgatttagctctacgctcgagggcacgaccggtgctcgatttagagtgctacgaagggaagggcagcgtcactctgttcccaccctctctcgtagcactctgagcgggctggcaaggcgcatagnnnnnn

SEQ ID NO: 262249 - DNA, 153 bp, Homo sapiens; identical to SEQ ID NO: 262233
  misc_feature: GYAE6OF01E2OG3.51.73.G07.1.454.CMB.1.raw
  modified_base (153)..(153): a, c, t, g, unknown or other
  misc_feature (153)..(153): n is a, c, g, or t

SEQ ID NO: 262250 - DNA, 164 bp, Homo sapiens
  misc_feature: GYAE6OF01BTJAT.51.73.G07.1.454.CMB.1.raw
  modified_base (153)..(164): a, c, t, g, unknown or other
  misc_feature (153)..(164): n is a, c, g, or t
tcagcgatcgtatacacgaccggtgctcgatttagctctacgctcagggcacggaccggtgctcgatttagagtgctacgaagggaaagggcagcgtcactctgttcccacctcctctcgtagcactctgagcgggctggcaaggcgcatagnnnnnnnnnnnn

SEQ ID NO: 262251 - DNA, 153 bp, Homo sapiens
  misc_feature: GYAE6OF01B9TNM.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagctgtgcgtcgaagggaaaggcagcgtcactctgttcccgccctcctctcgagcactctgagcgggctggcaaggcgcatagnn

SEQ ID NO: 262252 - DNA, 154 bp, Homo sapiens; identical to SEQ ID NO: 262231
  misc_feature: GYAE6OF01A9G4H.51.73.G07.1.454.CMB.1.raw
  modified_base (153)..(154): a, c, t, g, unknown or other
  misc_feature (153)..(154): n is a, c, g, or t

SEQ ID NO: 262253 - DNA, 153 bp, Homo sapiens; identical to SEQ ID NO: 262219
  misc_feature: GYAE6OF01EJMFX.51.73.G07.1.454.CMB.1.raw
  modified_base (153)..(153): a, c, t, g, unknown or other
  misc_feature (153)..(153): n is a, c, g, or t

SEQ ID NO: 262254 - DNA, 154 bp, Homo sapiens
  misc_feature: GYAE6OF01DGSYY.51.73.G07.1.454.CMB.1.raw
  modified_base (154)..(154): a, c, t, g, unknown or other
  misc_feature (154)..(154): n is a, c, g, or t
tcagcgatcgtatacacgaccggtgctcgatttagctctacgctcagggcacgaccggtgctcgatttagctgtgcgtcgaagggaaagggcagcgtcactctgttcccgccctcctctcgtagcactctgagcgggctggcaaggcgcatagn

SEQ ID NO: 262255 - DNA, 151 bp, Homo sapiens
  misc_feature: GYAE6OF01CBOYX.51.73.G07.1.454.CMB.1.raw
  modified_base (151)..(151): a, c, t, g, unknown or other
  misc_feature (151)..(151): n is a, c, g, or t
tcagcgatcgtatacacgaccggtgctcgatttagctctacgctcagggcacgaccggtgctcgatttagagtgctacgaagggaagggcagcgtcactctgttcccgcctcctctcgtagcactctgagcgggctggcaaggcgcatagn

SEQ ID NO: 262256 - DNA, 205 bp, Homo sapiens
  misc_feature: GYAE6OF01DURUK.51.73.G07.1.454.CMB.1.raw
  modified_base (191)..(205): a, c, t, g, unknown or other
  misc_feature (191)..(205): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaaggaaaggcagcgtcactctgttcccgcctcctctcgtagcactctgagcgggctggcaaggcgcatagnnnnnnnnnnnnnnn

SEQ ID NO: 262257 - DNA, 153 bp, Homo sapiens; identical to SEQ ID NO: 262233
  misc_feature: GYAE6OF01EG6EY.51.73.G07.1.454.CMB.1.raw
  modified_base (153)..(153): a, c, t, g, unknown or other
  misc_feature (153)..(153): n is a, c, g, or t

SEQ ID NO: 262258 - DNA, 153 bp, Homo sapiens
  misc_feature: GYAE6OF01EBGG8.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagtgtcacacgaagggaaagggcagcgtcactctgttcccaccctcctctcgtagcactctgagcgggctggcaaggcgcatagn

SEQ ID NO: 262259 - DNA, 155 bp, Homo sapiens
  misc_feature: GYAE6OF01BML97.51.73.G07.1.454.CMB.1.raw
  modified_base (153)..(155): a, c, t, g, unknown or other
  misc_feature (153)..(155): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnnn

SEQ ID NO: 262260 - DNA, 190 bp, Homo sapiens
  misc_feature: GYAE6OF01EVWDZ.51.73.G07.1.454.CMB.1.raw
  modified_base (187)..(190): a, c, t, g, unknown or other
  misc_feature (187)..(190): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaagggcagcgtcactctgttcccgccctcctctcgtagcactctgagcgggctggcaaggcgcatagnnnn

SEQ ID NO: 262261 - DNA, 154 bp, Homo sapiens
  misc_feature: GYAE6OF01CJ5ZP.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaacggtgctcgatttagagtgctacgaagggaaagggcagcgtcactctgttcccaccctcctctcgtagcactctgagcgggctggcaaggcgcatagnn

SEQ ID NO: 262262 - DNA, 154 bp, Homo sapiens; identical to SEQ ID NO: 262231
  misc_feature: GYAE6OF01BBXAU.51.73.G07.1.454.CMB.1.raw
  modified_base (153)..(154): a, c, t, g, unknown or other
  misc_feature (153)..(154): n is a, c, g, or t

SEQ ID NO: 262263 - DNA, 170 bp, Homo sapiens
  misc_feature: GYAE6OF01ER3MH.51.73.G07.1.454.CMB.1.raw
  modified_base (154)..(170): a, c, t, g, unknown or other
  misc_feature (154)..(170): n is a, c, g, or t
tcagcgatcgtatacacgaccggtgctcgatttagctctacgctcagggcgacgaccggtgctcgatttagagtgctacgaagggaaagggcagcgtcactctgttcccgccctcctctcgtagcactctgagcgggctggcaaggcgcatagnnnnnnnnnnnnnnnnn

SEQ ID NO: 262264 - DNA, 154 bp, Homo sapiens
  misc_feature: GYAE6OF01A48GX.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnn

SEQ ID NO: 262265 - DNA, 228 bp, Homo sapiens
  misc_feature: GYAE6OF01BMKZJ.51.73.G07.1.454.CMB.1.raw
  modified_base (216)..(216): a, c, t, g, unknown or other
  misc_feature (216)..(216): n is a, c, g, or t
  modified_base (222)..(228): a, c, t, g, unknown or other
  misc_feature (222)..(228): n is a, c, g, or t
tcagcgatcgtatacacgaccggtgctcgatttagctctacgctcagggcacgaccggtgctcgatttagctctacgctcgagggcacgaccggtgctcgatttacgctctacgctcgagggcacgaccggtgctcgatttagagtgctacgaagggaaggcagcgtcactctgttcccgcctcctctcgtagcactctgagcggctggcaaggcncatagnnnnnnn

SEQ ID NO: 262266 - DNA, 153 bp, Homo sapiens; identical to SEQ ID NO: 262219
  misc_feature: GYAE6OF01BNQ9F.51.73.G07.1.454.CMB.1.raw
  modified_base (153)..(153): a, c, t, g, unknown or other
  misc_feature (153)..(153): n is a, c, g, or t

SEQ ID NO: 262267 - DNA, 198 bp, Homo sapiens
  misc_feature: GYAE6OF01CXKTK.51.73.G07.1.454.CMB.1.raw
  modified_base (194)..(198): a, c, t, g, unknown or other
  misc_feature (194)..(198): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnnnn

SEQ ID NO: 262268 - DNA, 164 bp, Homo sapiens
  misc_feature: GYAE6OF01CNM6Z.51.73.G07.1.454.CMB.1.raw
  modified_base (151)..(164): a, c, t, g, unknown or other
  misc_feature (151)..(164): n is a, c, g, or t
tcagcgatcgtatacacgaccggtgctcgatttagctctacgctcagggcacgaccggtgctcgatttagagtgctacgaagggaaggcagcgtcactctgttcccaccctcctctcgtagcactctgagcgggctggcaaggcgcatagnnnnnnnnnnnnnn

SEQ ID NO: 262269 - DNA, 154 bp, Homo sapiens
  misc_feature: GYAE6OF01EGD89.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcaggacacgaccggtgctcgatttagagtgctacgaagggaaagggcagcgtcactctgttcccgccctcctctcgtagcactctgagcgggctggcaaggcgcatagnn

SEQ ID NO: 262270 - DNA, 154 bp, Homo sapiens
  misc_feature: GYAE6OF01B51VN.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaccggtgctcgatttagctacgctctaagggaaagggcagcgtcactctgttcccaccctcctctcgtagcactctgagcgggctggcaaggcgcatagnn

SEQ ID NO: 262271 - DNA, 155 bp, Homo sapiens; identical to SEQ ID NO: 262229
  misc_feature: GYAE6OF01AHCJ6.51.73.G07.1.454.CMB.1.raw
  modified_base (153)..(155): a, c, t, g, unknown or other
  misc_feature (153)..(155): n is a, c, g, or t

SEQ ID NO: 262272 - DNA, 166 bp, Homo sapiens
  misc_feature: GYAE6OF01ANCG5.51.73.G07.1.454.CMB.1.raw
  modified_base (154)..(166): a, c, t, g, unknown or other
  misc_feature (154)..(166): n is a, c, g, or t
tcagcgatcgtatacacgaccggtgctcgatttagctctacgctcaggggcacgaccggtgctcgatttagagtgctacgaagggaaagggcagcgtcactctgttcccgccctcctctcgtagcactctgagcgggctggcaaggcgcatagnnnnnnnnnnnnn

SEQ ID NO: 262273 - DNA, 152 bp, Homo sapiens; identical to SEQ ID NO: 262217
  misc_feature: GYAE6OF01AB9P8.51.73.G07.1.454.CMB.1.raw
  modified_base (152)..(152): a, c, t, g, unknown or other
  misc_feature (152)..(152): n is a, c, g, or t

SEQ ID NO: 262274 - DNA, 153 bp, Homo sapiens; identical to SEQ ID NO: 262214
  misc_feature: GYAE6OF01AJZ31.51.73.G07.1.454.CMB.1.raw
  modified_base (152)..(153): a, c, t, g, unknown or other
  misc_feature (152)..(153): n is a, c, g, or t

SEQ ID NO: 262275 - DNA, 160 bp, Homo sapiens; identical to SEQ ID NO: 262213
  misc_feature: GYAE6OF01A7880.51.73.G07.1.454.CMB.1.raw
  modified_base (152)..(160): a, c, t, g, unknown or other
  misc_feature (152)..(160): n is a, c, g, or t

SEQ ID NO: 262276 - DNA, 230 bp, Homo sapiens
  misc_feature: GYAE6OF01BJEDC.51.73.G07.1.454.CMB.1.raw
  modified_base (227)..(230): a, c, t, g, unknown or other
  misc_feature (227)..(230): n is a, c, g, or t
tcagcgatcgtatacacgaccggtgctcgatttagctctacgctcagggcacgaccggtgctcgatttagtcgagctctctcgcgggacgaccggtgctcgatttagtcgagctctctcgcgggcacgaccggtgctcgatttagagtgctacgaagggaaagggcagcgtcactctgttcccaccctcctctctagcactctgagcgggctggcaaggcgcatagnnnn

SEQ ID NO: 262277 - DNA, 157 bp, Homo sapiens
  misc_feature: GYAE6OF01D5LJL.51.73.G07.1.454.CMB.1.raw
  modified_base (152)..(157): a, c, t, g, unknown or other
  misc_feature (152)..(157): n is a, c, g, or t
tcagcgatcgtatacacgaccggtgctcgatttagctctacgctcagggcacgaccggtgctcgatttagagtgctacgaagggaaagggcagcgtcactctgttcccgcctcctctcgtagcactctgagcgggctggcaaggcgcatagnnnnnn

SEQ ID NO: 262278 - DNA, 194 bp, Homo sapiens
  misc_feature: GYAE6OF01BC2AZ.51.73.G07.1.454.CMB.1.raw
  modified_base (155)..(157): a, c, t, g, unknown or other
  misc_feature (155)..(157): n is a, c, g, or t
  modified_base (159)..(194): a, c, t, g, unknown or other
  misc_feature (159)..(194): n is a, c, g, or t
tcagcgatcgtatacacgaccggtgctcgatttagctctacgctcaggggcacgaccggtgctcgatttagagtgcacgaagggaaaggccagcgtcactctgttcccaccctcctctcgtagcactctgagcgggctgggcaaggcgtcatagnnngnnnnnnnnnnnnnnnnnnnnnnnnnnnnnnnnnnnn

SEQ ID NO: 262279 - DNA, 314 bp, Homo sapiens
  misc_feature: GYAE6OF01B4C2M.51.73.G07.1.454.CMB.1.raw
  modified_base (288)..(314): a, c, t, g, unknown or other
  misc_feature (288)..(314): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggttgttcgggtgttcggcggagggaccaagctgaccgtcctaggtcagcccaaggctgccccctcggtcactctgttcccgccatctgatcgtagcactctgaggcgggctggcaaggcgcagtagnnnnnnnnnnnnnnnnnnnnnnnnnnn

SEQ ID NO: 262280 - DNA, 162 bp, Homo sapiens
  misc_feature: GYAE6OF01EP9T8.51.73.G07.1.454.CMB.1.raw
  modified_base (154)..(162): a, c, t, g, unknown or other
  misc_feature (154)..(162): n is a, c, g, or t
tcagcgatcgtatacacgaccggtgctcgatttagctctacgctcagggacacgaccggtgctcgatttagagtgctacgaagggaaagggcagcgtcactctgttcccaccctcctctcgtagcactctgagcgggctggcaaggcgcatagnnnnnnnnn

SEQ ID NO: 262281 - DNA, 156 bp, Homo sapiens
  misc_feature: GYAE6OF01EK85X.51.73.G07.1.454.CMB.1.raw
  modified_base (154)..(156): a, c, t, g, unknown or other
  misc_feature (154)..(156): n is a, c, g, or t
tcagcgatcgtatacacgaccggtgctcgatttagctctacgctcagggcacgaccgggtgctcgatttagagtgctacgaagggaaagggcagcgtcactctgttcccaccctcctctcgtagcactctgagcgggctggcaaggcgcatagnnn

SEQ ID NO: 262282 - DNA, 152 bp, Homo sapiens
  misc_feature: GYAE6OF01B5HPP.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcacctgagcgggctggcaaggcgcatagn

SEQ ID NO: 262283 - DNA, 194 bp, Homo sapiens
  misc_feature: GYAE6OF01DVGNC.51.73.G07.1.454.CMB.1.raw
  modified_base (194)..(194): a, c, t, g, unknown or other
  misc_feature (194)..(194): n is a, c, g, or t
tcagcgatcgtatacacgaccggtgctcgatttagctctacgctcagggcacgaccggtgctcgatttagcgagacgcgcagggcacgaccggtgctcgatttagtcacgcgagaaagggaaggctggccctgacgtgtttctgttcccgccctcctctcgtagcactctgagcgggctggcaaggcgcatagn

SEQ ID NO: 262284 - DNA, 188 bp, Homo sapiens
  misc_feature: GYAE6OF01CA41W.51.73.G07.1.454.CMB.1.raw
  modified_base (187)..(188): a, c, t, g, unknown or other
  misc_feature (187)..(188): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaagggcagcgtcactctgttcccgccctcctctcgtagcactctgagcgggctggcaaggcgcatagnn

SEQ ID NO: 262285 - DNA, 153 bp, Homo sapiens
  misc_feature: GYAE6OF01CJTY8.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagctgtgcgtcgaagggaaagggcagcgtcactctgttcccacctcctctcgtagcactctgagcgggctggcaaggcgcatagn

SEQ ID NO: 262286 - DNA, 156 bp, Homo sapiens
  misc_feature: GYAE6OF01BJ2GH.51.73.G07.1.454.CMB.1.raw
  modified_base (154)..(156): a, c, t, g, unknown or other
  misc_feature (154)..(156): n is a, c, g, or t
tcagcgatcgtatacacgaccggtgctcgatttagctctacgctcagggcacgaccggtgctcgatttagtctgacgtcaaagggaaagggcagcgtcactctgttcccaccctcctctcgtagcactctgagcgggctggcaaggcgcatagnnn

SEQ ID NO: 262287 - DNA, 163 bp, Homo sapiens
  misc_feature: GYAE6OF01D4R8M.51.73.G07.1.454.CMB.1.raw
  modified_base (153)..(163): a, c, t, g, unknown or other
  misc_feature (153)..(163): n is a, c, g, or t
tcagcgatcgtatacacgaccggtgctcgatttagctctacgctcagggcgacgaccggtgctcgatttagagtgctacgaagggaaaggcagcgtcactctgttcccaccctcctctcgtagcactctgagcgggctggcaaggcgcatagnnnnnnnnnnn

SEQ ID NO: 262288 - DNA, 230 bp, Homo sapiens
  misc_feature: GYAE6OF01A978Y.51.73.G07.1.454.CMB.1.raw
  modified_base (226)..(230): a, c, t, g, unknown or other
  misc_feature (226)..(230): n is a, c, g, or t
tcagcgatcgtatacacgaccggtgctcgatttagctctacgctcagggcacgaccggtgctcgatttagcgagacgcgcagggcacgaccggtgctcgatttagtcacgcgagaaagggaaggcacgaccggtgctcgatttagaatgctacgaagggaaaggcagcgtcactctgttcccacctcctctcgtagcactctgagcgggctggcaaggcgcatagnnnnn

SEQ ID NO: 262289 - DNA, 153 bp, Homo sapiens; identical to SEQ ID NO: 262233
  misc_feature: GYAE6OF01B9TCD.51.73.G07.1.454.CMB.1.raw
  modified_base (153)..(153): a, c, t, g, unknown or other
  misc_feature (153)..(153): n is a, c, g, or t

SEQ ID NO: 262290 - DNA, 153 bp, Homo sapiens; identical to SEQ ID NO: 262219
  misc_feature: GYAE6OF01D5DQD.51.73.G07.1.454.CMB.1.raw
  modified_base (153)..(153): a, c, t, g, unknown or other
  misc_feature (153)..(153): n is a, c, g, or t

SEQ ID NO: 262291 - DNA, 154 bp, Homo sapiens; identical to SEQ ID NO: 262264
  misc_feature: GYAE6OF01A1ECO.51.73.G07.1.454.CMB.1.raw
  modified_base (153)..(154): a, c, t, g, unknown or other
  misc_feature (153)..(154): n is a, c, g, or t

SEQ ID NO: 262292 - DNA, 153 bp, Homo sapiens
  misc_feature: GYAE6OF01CQSQ1.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagctgtgcgtcgaagggaaaggcagcgtcactctgttcccacctcctctcgtagcactctgagcgggctggcaaggcgcatagnn

SEQ ID NO: 262293 - DNA, 152 bp, Homo sapiens; identical to SEQ ID NO: 262244
  misc_feature: GYAE6OF01AKGIU.51.73.G07.1.454.CMB.1.raw
  modified_base (152)..(152): a, c, t, g, unknown or other
  misc_feature (152)..(152): n is a, c, g, or t

SEQ ID NO: 262294 - DNA, 154 bp, Homo sapiens
  misc_feature: GYAE6OF01BQZD5.51.73.G07.1.454.CMB.1.raw
  modified_base (154)..(154): a, c, t, g, unknown or other
  misc_feature (154)..(154): n is a, c, g, or t
tcagcgatcgtatacacgaccggtgctcgatttagctctacgctcagggcacgaccggtgctcgatttagctgtgcgtcgaagggaaagggcagcgtcactctgttcccaccctcctctcgtagcactctgagcgggctggcaaggcgcatagn

SEQ ID NO: 262295 - DNA, 163 bp, Homo sapiens
  misc_feature: GYAE6OF01BT0IF.51.73.G07.1.454.CMB.1.raw
  modified_base (162)..(163): a, c, t, g, unknown or other
  misc_feature (162)..(163): n is a, c, g, or t
tcagcgatcgtatacacgaccggtgctcgatttagctctacgctcagggcacgaccggtgctcgatttagtcacgcgagaaagggaaaggggctggccctgacgtgtttctgttcccaccctcctctcgtagcactctgagcgggctggcaaggcgcatagnn

SEQ ID NO: 262296 - DNA, 153 bp, Homo sapiens
  misc_feature: GYAE6OF01DFPKL.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagctgtgcgtcgaagggaaaggcagcgtcactctgttcccgcctcctctcgtagcactctgagcgggctggcaaggcgcatagnn

SEQ ID NO: 262297 - DNA, 153 bp, Homo sapiens
  misc_feature: GYAE6OF01CBBFR.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagagtgctacggaagggaagggcagcgtcactctgttcccgccctcctctcgtagcactctgagcgggctggcaaggcgcatagn

SEQ ID NO: 262298 - DNA, 153 bp, Homo sapiens
  misc_feature: GYAE6OF01DFNQF.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgatcgatttagctgtgcgtcgaagggaaagggcagcgtcactctgttcccacctcctctcgtagcactctgagcgggctggcaaggcgcatagn

SEQ ID NO: 262299 - DNA, 242 bp, Homo sapiens
  misc_feature: GYAE6OF01EDU8H.51.73.G07.1.454.CMB.1.raw
  modified_base (132)..(132): a, c, t, g, unknown or other
  misc_feature (132)..(132): n is a, c, g, or t
  modified_base (188)..(188): a, c, t, g, unknown or other
  misc_feature (188)..(188): n is a, c, g, or t
  modified_base (196)..(203): a, c, t, g, unknown or other
  misc_feature (196)..(203): n is a, c, g, or t
  modified_base (205)..(205): a, c, t, g, unknown or other
  misc_feature (205)..(205): n is a, c, g, or t
  modified_base (207)..(242): a, c, t, g, unknown or other
  misc_feature (207)..(242): n is a, c, g, or t
tcagcgatcgtatacacgaccggtgctcgatttagctctacgctcaggggcacggaccggtgctcgatttagcgtctacgctcagggcagaccggtgctcgatttagagtgctacgaagggaaggcagcgtnactctggttccccaccctctctcgtaggcactctgagcgggctgggccaaaggtcncgagtagnnnnnnnngngnnnnnnnnnnnnnnnnnnnnnnnnnnnnnnnnnnnn

SEQ ID NO: 262300 - DNA, 287 bp, Homo sapiens
  misc_feature: GYAE6OF01DT6VR.51.73.G07.1.454.CMB.1.raw
  modified_base (284)..(287): a, c, t, g, unknown or other
  misc_feature (284)..(287): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccgccatctgatcgtagcactctgagcgggctggcaaggcgcatagnnnn

SEQ ID NO: 262301 - DNA, 236 bp, Homo sapiens
  misc_feature: GYAE6OF01DS6UH.51.73.G07.1.454.CMB.1.raw
  modified_base (196)..(236): a, c, t, g, unknown or other
  misc_feature (196)..(236): n is a, c, g, or t
tcagcgatcgtatacacgaccggtgctcgatttagctctacgctcaggggcacggaccggtgctcggatttagctctacgcgtcagggcacgaccggtgcctcggatttagagtgctacgaagggaaggcagcgtcactctgttcccaccctccgtctcggtacgcactctcgagcgggctggccaaggcgcatgnnnnnnnnnnnnnnnnnnnnnnnnnnnnnnnnnnnnnnnnn

SEQ ID NO: 262302 - DNA, 179 bp, Homo sapiens
  misc_feature: GYAE6OF01ACMR3.51.73.G07.1.454.CMB.1.raw
  modified_base (151)..(179): a, c, t, g, unknown or other
  misc_feature (151)..(179): n is a, c, g, or t
tcagcgatcgtatacacgaccggtgctcgatttagctctacgctcagggcacgaccggtgctcgagttatccacgcccagagctcgaaaacaccgttcatcttcccgccatctgatcgtagcactctgagcgggctggcaaggcgcatagnnnnnnnnnnnnnnnnnnnnnnnnnnnnn

SEQ ID NO: 262303 - DNA, 153 bp, Homo sapiens
  misc_feature: GYAE6OF01CL3BS.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagagtgctacgaagggaaagggcagcgtcactctgttcacgccctcctctcgtagcactctgagcgggctggcaaggcgcatagn

SEQ ID NO: 262304 - DNA, 152 bp, Homo sapiens; identical to SEQ ID NO: 262246
  misc_feature: GYAE6OF01ARXFA.51.73.G07.1.454.CMB.1.raw

SEQ ID NO: 262305 - DNA, 153 bp, Homo sapiens; identical to SEQ ID NO: 262233
  misc_feature: GYAE6OF01D3GM2.51.73.G07.1.454.CMB.1.raw
  modified_base (153)..(153): a, c, t, g, unknown or other
  misc_feature (153)..(153): n is a, c, g, or t

SEQ ID NO: 262306 - DNA, 288 bp, Homo sapiens
  misc_feature: GYAE6OF01EYC19.51.73.G07.1.454.CMB.1.raw
  modified_base (286)..(288): a, c, t, g, unknown or other
  misc_feature (286)..(288): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttccccgccatctgatcgtagcactctgagcgggctggcaaggcgcatagnnn

SEQ ID NO: 262307 - DNA, 154 bp, Homo sapiens; identical to SEQ ID NO: 262231
  misc_feature: GYAE6OF01BQ7WZ.51.73.G07.1.454.CMB.1.raw
  modified_base (153)..(154): a, c, t, g, unknown or other
  misc_feature (153)..(154): n is a, c, g, or t

SEQ ID NO: 262308 - DNA, 152 bp, Homo sapiens
  misc_feature: GYAE6OF01DZOWJ.51.73.G07.1.454.CMB.1.raw
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatag

SEQ ID NO: 262309 - DNA, 228 bp, Homo sapiens
  misc_feature: GYAE6OF01BNBZP.51.73.G07.1.454.CMB.1.raw
  modified_base (222)..(228): a, c, t, g, unknown or other
  misc_feature (222)..(228): n is a, c, g, or t
tcagcgatcgtatacacgaccggtgctcgatttagctctacgctcagggcacgaccggtgctcgatttagctctacgctcagggcacgaccggtgctcgatttagcgagacgcgcagggcacgaccggtgctcgatttagagtgctacgaagggaaaggcagcgtcactctgttcccgccctcctctcgtagcactctgagcgggctggcaaggcgcatagnnnnnnn

SEQ ID NO: 262310 - DNA, 153 bp, Homo sapiens; identical to SEQ ID NO: 262219
  misc_feature: GYAE6OF01BT5AP.51.73.G07.1.454.CMB.1.raw
  modified_base (153)..(153): a, c, t, g, unknown or other
  misc_feature (153)..(153): n is a, c, g, or t

SEQ ID NO: 262311 - DNA, 166 bp, Homo sapiens
  misc_feature: GYAE6OF01BRCB3.51.73.G07.1.454.CMB.1.raw
  modified_base (150)..(166): a, c, t, g, unknown or other
  misc_feature (150)..(166): n is a, c, g, or t
tcagcgatcgtatacacgaccggtgctcgatttagctctacgctcagggcgacgaccggtgctcgatttagagtgctacgaagggaagggcagcgtcactctgttcccacctctctcgtagcactctgagcggctggcaaggcgcatagnnnnnnnnnnnnnnnnn

SEQ ID NO: 262312 - DNA, 154 bp, Homo sapiens; identical to SEQ ID NO: 262231
  misc_feature: GYAE6OF01EZVOS.51.73.G07.1.454.CMB.1.raw
  modified_base (153)..(154): a, c, t, g, unknown or other
  misc_feature (153)..(154): n is a, c, g, or t

SEQ ID NO: 262313 - DNA, 193 bp, Homo sapiens
  misc_feature: GYAE6OF01D54MK.51.73.G07.1.454.CMB.1.raw
  modified_base (192)..(193): a, c, t, g, unknown or other
  misc_feature (192)..(193): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaggcagcgtcactctgttcccgccctcctctcgtagcactctgagcgggctggcaaggcgcatagnn

SEQ ID NO: 262314 - DNA, 153 bp, Homo sapiens
  misc_feature: GYAE6OF01C82SO.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagagtgctacgaagggaaatggcagcgtcactctgttcccgccctcctctcgtagcactctgagcgggctggcaaggcgcatagn

SEQ ID NO: 262315 - DNA, 152 bp, Homo sapiens
  misc_feature: GYAE6OF01A95XP.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaaagggcagcgtcactctgttcccaccctctctcgtagcactctgagcgggctggcaaggcgcatagn

SEQ ID NO: 262316 - DNA, 166 bp, Homo sapiens
  misc_feature: GYAE6OF01A45NU.51.73.G07.1.454.CMB.1.raw
  modified_base (152)..(166): a, c, t, g, unknown or other
  misc_feature (152)..(166): n is a, c, g, or t
tcagcgatcgtatacacgaccggtgctcgatttagctctacgctcagggcacgaccggtgctcgatttagagtgctacgaagggaaaggcagcgtcactctgttcccgccctcctctcgtagcactctgagcgggctggcaaggcgcatagnnnnnnnnnnnnnnn

SEQ ID NO: 262317 - DNA, 311 bp, Homo sapiens
  misc_feature: GYAE6OF01EQQ32.51.73.G07.1.454.CMB.1.raw
  modified_base (294)..(311): a, c, t, g, unknown or other
  misc_feature (294)..(311): n is a, c, g, or t
tcagcgatcgtatacacgaccggtgctcgatttagctctacgctcaggggcacgaccggtgcctcgatttagagctcacgtattgggggcaaagctcgccctgaccctttcgggtgcgcagcctgaggatgaggctgagtatttactggcttgctctcctatagtggtgttccgggtgttccggcggagggaccaagctgaccgtcctaggtcaggcccaaggctcgcccctggtccacgtctgttcccgccatctgatcgtagcactctgagcgggctggcaaggcgcatagnnnnnnnnnnnnnnnnnn

SEQ ID NO: 262318 - DNA, 153 bp, Homo sapiens; identical to SEQ ID NO: 262219
  misc_feature: GYAE6OF01B0T48.51.73.G07.1.454.CMB.1.raw
  modified_base (153)..(153): a, c, t, g, unknown or other
  misc_feature (153)..(153): n is a, c, g, or t

SEQ ID NO: 262319 - DNA, 188 bp, Homo sapiens
  misc_feature: GYAE6OF01ESXPS.51.73.G07.1.454.CMB.1.raw
  modified_base (185)..(188): a, c, t, g, unknown or other
  misc_feature (185)..(188): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaggcagcgtcactctgttcccgcctcctctcgtagcactctgagcgggctggcaaggcgcatagnnnn

SEQ ID NO: 262320 - DNA, 160 bp, Homo sapiens; identical to SEQ ID NO: 262230
  misc_feature: GYAE6OF01BTRN8.51.73.G07.1.454.CMB.1.raw
  modified_base (153)..(160): a, c, t, g, unknown or other
  misc_feature (153)..(160): n is a, c, g, or t

SEQ ID NO: 262321 - DNA, 170 bp, Homo sapiens
  misc_feature: GYAE6OF01CI5Q9.51.73.G07.1.454.CMB.1.raw
  modified_base (153)..(170): a, c, t, g, unknown or other
  misc_feature (153)..(170): n is a, c, g, or t
tcagcgatcgtatacacgaccggtgctcgatttagctctacgctcagggcacgaccggtgctcgagtttagagtgctacgaagggaagggcagcgtcactctgttcccaccctcctctcgtagcactctgagcgggctggcaaggcgcatagnnnnnnnnnnnnnnnnnn

SEQ ID NO: 262322 - DNA, 197 bp, Homo sapiens
  misc_feature: GYAE6OF01CE9O1.51.73.G07.1.454.CMB.1.raw
  modified_base (194)..(197): a, c, t, g, unknown or other
  misc_feature (194)..(197): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatagnnnn

SEQ ID NO: 262323 - DNA, 197 bp, Homo sapiens
  misc_feature: GYAE6OF01EY14D.51.73.G07.1.454.CMB.1.raw
  modified_base (195)..(197): a, c, t, g, unknown or other
  misc_feature (195)..(197): n is a, c, g, or t
tcagcgatcgtatacacgaccggtgctcgatttagctctacgctcagggcacgaccggtgctcgatttagagtgctacggaagggaaagggcacgaccggtgctcgatttagagtgctacgaagggaaagggcagcgtcactctgttcccaccctcctctcgtagcactctgagcgggctggcaaggcgcatagnnn

SEQ ID NO: 262324 - DNA, 178 bp, Homo sapiens
  misc_feature: GYAE6OF01DNAFO.51.73.G07.1.454.CMB.1.raw
  modified_base (156)..(178): a, c, t, g, unknown or other
  misc_feature (156)..(178): n is a, c, g, or t
tcagcgatcgtatacacgaccggtgctcgatttagctctacgctcagggtcgacgaccggtgctcgatttagctgtgcgtcgaagggaaagggcagcgtcactctgttcccaccctcctctcgtagcactctgagcgggctggcaaggcgcatagnnnnnnnnnnnnnnnnnnnnnnn

SEQ ID NO: 262325 - DNA, 155 bp, Homo sapiens; identical to SEQ ID NO: 262229
  misc_feature: GYAE6OF01CVPSP.51.73.G07.1.454.CMB.1.raw
  modified_base (153)..(155): a, c, t, g, unknown or other
  misc_feature (153)..(155): n is a, c, g, or t

SEQ ID NO: 262326 - DNA, 189 bp, Homo sapiens
  misc_feature: GYAE6OF01EB6ML.51.73.G07.1.454.CMB.1.raw
  modified_base (187)..(189): a, c, t, g, unknown or other
  misc_feature (187)..(189): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaagggcagcgtcactctgttcccgcctcctctcgtagcactctgagcgggctggcaaggcgcatagnnn

SEQ ID NO: 262327 - DNA, 236 bp, Homo sapiens
  misc_feature: GYAE6OF01ALWRM.51.73.G07.1.454.CMB.1.raw
  modified_base (229)..(236): a, c, t, g, unknown or other
  misc_feature (229)..(236): n is a, c, g, or t
tcagcgatcgtatacacgaccggtgctcgatttagctctacgctcagggcacgaccggtgctcgatttagacagtatatatccgcgggcacgaccggtgctcgatttagacagtatatatccgcgggcacgaccggtgctcgatttagagtgctacgaagggaagggcagcgtcactctgttcccgccctcctctcgtagcactctgagcggctggcaaggcgcatagnnnnnnnn

SEQ ID NO: 262328 - DNA, 155 bp, Homo sapiens; identical to SEQ ID NO: 262259
  misc_feature: GYAE6OF01CN7QA.51.73.G07.1.454.CMB.1.raw
  modified_base (153)..(155): a, c, t, g, unknown or other
  misc_feature (153)..(155): n is a, c, g, or t

SEQ ID NO: 262329 - DNA, 155 bp, Homo sapiens
  misc_feature: GYAE6OF01E3QF5.51.73.G07.1.454.CMB.1.raw
  modified_base (154)..(155): a, c, t, g, unknown or other
  misc_feature (154)..(155): n is a, c, g, or t
tcagcgatcgtatacacgaccggtgctcgatttagctctacgctcagggcacgaccggtgctcgatttagctgtgcgtcgaagggaaagggcagcgtcactctgttcccaccctcctctcgtagcactctgagcgggctggcaaggcgcatagnn

SEQ ID NO: 262330 - DNA, 170 bp, Homo sapiens
  misc_feature: GYAE6OF01C0TUG.51.73.G07.1.454.CMB.1.raw
  modified_base (148)..(148): a, c, t, g, unknown or other
  misc_feature (148)..(148): n is a, c, g, or t
  modified_base (153)..(170): a, c, t, g, unknown or other
  misc_feature (153)..(170): n is a, c, g, or t
tcagcgatcgtatacacgaccggtgctcgatttagctctacgctcagggcgacgaccggtgctcgatttagagtgctacgaagggaaggtcagcgtcactctgttcccaccctcctctcgtagcactctgagcgggctggcaaggcgnatagnnnnnnnnnnnnnnnnnn

SEQ ID NO: 262331 - DNA, 530 bp, Homo sapiens
  misc_feature: GYAE6OF01DB3TM.51.73.G07.1.454.CMB.1.raw
  modified_base (240)..(240): a, c, t, g, unknown or other
  misc_feature (240)..(240): n is a, c, g, or t
tcagcgatcgtatacacgaccggtgctcgatttagctctacgctcagggcacgaccggtgctcgatttagtacacgtgattagggattggggggaggaactgctcagttaggacccagagggaaccatggaagccccagctcagcttctcttcctcctgctactctggctcccagataccatcggggaaactgtgttgacacagtctccagccaccctgtctttgtctccgaggggaaangccaccctctcctgcagggccagtgagagtattgacatcttcttggcctggtaccaacagaaacctggccaggctccccgactcctcatttatgatgcatccaaaagggtcgttggcatcccagccaggtcagtggcagtgggtctgggacaggtaatcactctcacccatcaaccagactagacgcctgaagtatttgactagtttaattactgtcagtcagactaacaacgtgtctctcttcgggcggagggaccagggtggagacgtacaaacgactggtgctacgg

SEQ ID NO: 262332 - DNA, 153 bp, Homo sapiens
  misc_feature: GYAE6OF01E6CIT.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagtgtagtgtgaagggaaagggcagcgtcactctgttcccgccctcctctcgtagcactctgagcgggctggcaaggcgcatagn

SEQ ID NO: 262333 - DNA, 162 bp, Homo sapiens
  misc_feature: GYAE6OF01C7AF8.51.73.G07.1.454.CMB.1.raw
  modified_base (146)..(146): a, c, t, g, unknown or other
  misc_feature (146)..(146): n is a, c, g, or t
  modified_base (152)..(162): a, c, t, g, unknown or other
  misc_feature (152)..(162): n is a, c, g, or t
tcagcgatcgtatacacgaccggtgctcgatttagctctacgctcagggcacgaccggtgctcgatttagagtgctacgaaggaaaggcagccgtcactctgttcccgccctcctctcgtagcactctgagcgggctggcaaggcncatagnnnnnnnnnnn

SEQ ID NO: 262334 - DNA, 154 bp, Homo sapiens; identical to SEQ ID NO: 262231
  misc_feature: GYAE6OF01EE2GY.51.73.G07.1.454.CMB.1.raw
  modified_base (153)..(154): a, c, t, g, unknown or other
  misc_feature (153)..(154): n is a, c, g, or t

SEQ ID NO: 262335 - DNA, 154 bp, Homo sapiens; identical to SEQ ID NO: 262231
  misc_feature: GYAE6OF01B3NYM.51.73.G07.1.454.CMB.1.raw
  modified_base (153)..(154): a, c, t, g, unknown or other
  misc_feature (153)..(154): n is a, c, g, or t

SEQ ID NO: 262336 - DNA, 193 bp, Homo sapiens
  misc_feature: GYAE6OF01B4B9L.51.73.G07.1.454.CMB.1.raw
  modified_base (193)..(193): a, c, t, g, unknown or other
  misc_feature (193)..(193): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaaggcagcgtcactctgttcccaccctcctctcgtagcactctgagcgggctggcaaggcgcatagn

SEQ ID NO: 262337 - DNA, 154 bp, Homo sapiens
  misc_feature: GYAE6OF01BXTDW.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaccggtgctcgatttagtgtcacacgaagggaaagggcagcgtcactctgttcccaccctcctctcgtagcactctgagcgggctggcaaggcgcatagnn

SEQ ID NO: 262338 - DNA, 741 bp, Homo sapiens
  misc_feature: GYAE6OF01C6MPL.51.73.G07.1.454.CMB.1.raw
  modified_base (240)..(240): a, c, t, g, unknown or other
  misc_feature (240)..(240): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtcctccgaggggaaanacgccaccctctcctgcgaggccagtgagagtatgacatcttcttggcctggtaccaacagaaaccgtggccacggcctccccgactcctctatttatgatgacactaccgtaaaagggtcgttggctactcccacgccgtaggttcgaggtcggactaggtgggtacgtaggggacaagtaacgttcacctccgtacctaaccctaacttaccaaaccgaacgaaccttaacggaacggtacccttagggtaaacgtttacgtttttacggactttaaacggtttttaactttaaccgttcggttaccgtaggtacctaacggttaacccggttaaacccgtaaacgttccgggttaccttacccggtttaccggttttacccgggggacccgggggtaaaccgggggtaacccgtaaaggggggttacgggaaacggttaacggttaaacccggaaaaaccggttaacggttacgggtcggggtcccgttaaaccgggg

SEQ ID NO: 262339 - DNA, 535 bp, Homo sapiens
  misc_feature: GYAE6OF01DRGGD.51.73.G07.1.454.CMB.1.raw
  modified_base (238)..(238): a, c, t, g, unknown or other
  misc_feature (238)..(238): n is a, c, g, or t
  modified_base (407)..(407): a, c, t, g, unknown or other
  misc_feature (407)..(407): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtattgacatcttcttggcctggtaccaacagaaacctggccaggctccccgactcctcatttatgatgcatccaaagggtcgttggcatcccagccaggttcagtggcagtgggtctgggacagaattcactctcaccntacaccagactagacgcctgaagtattttgctagtttaattactgtcagcagtacgtaacaacgtcggtctcgttcgttcgggcggagggaccgagggtaggagagtacgaaacgtatggtggctacg

SEQ ID NO: 262340 - DNA, 153 bp, Homo sapiens
  misc_feature: GYAE6OF01EP8DB.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgctcgatttagctgtgcgtcgaagggaagggcagcgtcactctgttcccaccctcctctcgtagcactctgagcgggctggcaaggcgcatagn

SEQ ID NO: 262341 - DNA, 154 bp, Homo sapiens; identical to SEQ ID NO: 262231
  misc_feature: GYAE6OF01CLL5Q.51.73.G07.1.454.CMB.1.raw
  modified_base (153)..(154): a, c, t, g, unknown or other
  misc_feature (153)..(154): n is a, c, g, or t

SEQ ID NO: 262342 - DNA, 602 bp, Homo sapiens
  misc_feature: GYAE6OF01DQPYA.51.73.G07.1.454.CMB.1.raw
  modified_base (238)..(238): a, c, t, g, unknown or other
  misc_feature (238)..(238): n is a, c, g, or t
  modified_base (384)..(384): a, c, t, g, unknown or other
  misc_feature (384)..(384): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccacggcctccccgactcctctatttatgatgcataccaaaagggtcgttagctactcccagcctaggttcagtggcnggtgggtcgtgggacagtaattcactctacaccatacacagactagacgcctagaacgtattttcgacgtagttttattaacgttcgtacgtagacgtacgtaccgtaacgaacgtcgtaccgttccttacgttttccgggacgggtaggggtaacccggtaaggggtacgggaagtaaccgtacgtaaaaccgacgttacggtacggccgttaccgg

SEQ ID NO: 262343 - DNA, 153 bp, Homo sapiens; identical to SEQ ID NO: 262219
  misc_feature: GYAE6OF01AYZBH.51.73.G07.1.454.CMB.1.raw
  modified_base (153)..(153): a, c, t, g, unknown or other
  misc_feature (153)..(153): n is a, c, g, or t

SEQ ID NO: 262344 - DNA, 197 bp, Homo sapiens
  misc_feature: GYAE6OF01BKYJL.51.73.G07.1.454.CMB.1.raw
  modified_base (192)..(197): a, c, t, g, unknown or other
  misc_feature (192)..(197): n is a, c, g, or t
tcagcgatcgtatacacgaccggtgctcgatttagctctacgctcagggcacgaccggtgctcgatttagtctagcgacttccgcgggcacgaccggtgctcgatttagagtgctacgaagggaaagggcagcgtcactctgttcccaccctcctctcgtagcactctgagcgggctggcaaggcgcatagnnnnnn

SEQ ID NO: 262345 - DNA, 154 bp, Homo sapiens; identical to SEQ ID NO: 262264
  misc_feature: GYAE6OF01B30H3.51.73.G07.1.454.CMB.1.raw
  modified_base (153)..(154): a, c, t, g, unknown or other
  misc_feature (153)..(154): n is a, c, g, or t

SEQ ID NO: 262346 - DNA, 153 bp, Homo sapiens
  misc_feature: GYAE6OF01CVMWI.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagagtgctacgaagggaaagggcagcgtcactctgttcccaccctctctcgtagcactctgagcgggctggcaaggcgcatagnn

SEQ ID NO: 262347 - DNA, 180 bp, Homo sapiens
  misc_feature: GYAE6OF01CTSYK.51.73.G07.1.454.CMB.1.raw
  modified_base (158)..(180): a, c, t, g, unknown or other
  misc_feature (158)..(180): n is a, c, g, or t
tcagcgatcgtatacacgaccggtgctcgatttagctctacgctcaggggtcgacgaccgggtgctcgatttagctgtggcgtcgaagggaagggcagcgtcactctgttcccaccctcctctcgtagcactctgagcgggctggcaaggcgcatagnnnnnnnnnnnnnnnnnnnnnnn

SEQ ID NO: 262348 - DNA, 153 bp, Homo sapiens; identical to SEQ ID NO: 262296
  misc_feature: GYAE6OF01BXNAW.51.73.G07.1.454.CMB.1.raw
  modified_base (152)..(153): a, c, t, g, unknown or other
  misc_feature (152)..(153): n is a, c, g, or t

SEQ ID NO: 262349 - DNA, 200 bp, Homo sapiens
  misc_feature: GYAE6OF01BUMY0.51.73.G07.1.454.CMB.1.raw
  modified_base (190)..(200): a, c, t, g, unknown or other
  misc_feature (190)..(200): n is a, c, g, or t
tcagcgatcgtatacacgaccggtgctcgatttagctctacgctctagggtcgacgaccggtgctcgatttacgctctacgctcagggcacgaccggtgctcgatttagagtgctacgaagggaaggcagcgtcactctgttcccaccctccgtctcgtagcactctgagcggctggcaaggcgcatagnnnnnnnnnnn

SEQ ID NO: 262350 - DNA, 181 bp, Homo sapiens
  misc_feature: GYAE6OF01AEUAC.51.73.G07.1.454.CMB.1.raw
  modified_base (154)..(154): a, c, t, g, unknown or other
  misc_feature (154)..(154): n is a, c, g, or t
  modified_base (161)..(181): a, c, t, g, unknown or other
  misc_feature (161)..(181): n is a, c, g, or t
tcagcgatcgtatacacgaccggtgctcgatttagctctacgctcgagggcacgaccggtgctcgatttagagtgctacggaagggaaggcagcgtcactctcgttcccaccctcctctcgtagcactcgtggaggcgggctggaccaagggcnctaatgnnnnnnnnnnnnnnnnnnnnn

SEQ ID NO: 262351 - DNA, 153 bp, Homo sapiens
  misc_feature: GYAE6OF01EZ927.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcaggacacgaccggtgctcgatttatccacgcccagagctcgaaaacaccgttcatcttcccgccatctgatcgtagcactgtgagcgggctgggcaaggcgcatagnn

SEQ ID NO: 262352 - DNA, 165 bp, Homo sapiens
  misc_feature: GYAE6OF01CUQD1.51.73.G07.1.454.CMB.1.raw
  modified_base (151)..(165): a, c, t, g, unknown or other
  misc_feature (151)..(165): n is a, c, g, or t
tcagcgatcgtatacacgaccggtgctcgatttagctctacgctcagggcacgaccggtgctcgatttagagtgctacgaagggaaaggcagcgtcactctcgttcccacctctctcgtagcactctgagcgggctggcaaggcgcatagnnnnnnnnnnnnnnn

SEQ ID NO: 262353 - DNA, 160 bp, Homo sapiens
  misc_feature: GYAE6OF01ABPYR.51.73.G07.1.454.CMB.1.raw
  modified_base (127)..(127): a, c, t, g, unknown or other
  misc_feature (127)..(127): n is a, c, g, or t
  modified_base (148)..(160): a, c, t, g, unknown or other
  misc_feature (148)..(160): n is a, c, g, or t
tcagcgatcgtatacacgaccggtgctcgatttagctctacgctcagggcacgaccggtgctcgatttagagtgctacgaggaaggcagcgtcactctgttccaccctcctctcgtagcactctgancgggctggcaaggcgcatagnnnnnnnnnnnnn

SEQ ID NO: 262354 - DNA, 157 bp, Homo sapiens
  misc_feature: GYAE6OF01A0O9S.51.73.G07.1.454.CMB.1.raw
  modified_base (128)..(128): a, c, t, g, unknown or other
  misc_feature (128)..(128): n is a, c, g, or t
  modified_base (152)..(157): a, c, t, g, unknown or other
  misc_feature (152)..(157): n is a, c, g, or t
tcagcgatcgtatacacgaccggtgctcgatttagctctacgctcagggcacgaccggtgctcgatttagagtgctacgaagggaaaggcagcgtcactctgttcccgccctcctctcgtagcactcngagcgggctggacaggcgcatagnnnnnn

SEQ ID NO: 262355 - DNA, 153 bp, Homo sapiens; identical to SEQ ID NO: 262233
  misc_feature: GYAE6OF01ELM2P.51.73.G07.1.454.CMB.1.raw
  modified_base (153)..(153): a, c, t, g, unknown or other
  misc_feature (153)..(153): n is a, c, g, or t

SEQ ID NO: 262356 - DNA, 193 bp, Homo sapiens
  misc_feature: GYAE6OF01AV7WG.51.73.G07.1.454.CMB.1.raw
  modified_base (189)..(193): a, c, t, g, unknown or other
  misc_feature (189)..(193): n is a, c, g, or t
tcagcgatcgtatacacgaccggtgctcgatttagctctacgctcagggcacgaccggtgatcgatttagcgagacgcgcagggcacgaccggtgctcgatttagctgtgcgtcgaagggaaagggcagcgtcactctgttcccaccctcctctcgtagcactctgagcgggctggcaaggcgcatagnnnnn

SEQ ID NO: 262357 - DNA, 566 bp, Homo sapiens
  misc_feature: GYAE6OF01DSG93.51.73.G07.1.454.CMB.1.raw
  modified_base (146)..(146): a, c, t, g, unknown or other
  misc_feature (146)..(146): n is a, c, g, or t
  modified_base (217)..(217): a, c, t, g, unknown or other
  misc_feature (217)..(217): n is a, c, g, or t
tcagcgatcgtatacacgaccggtgctcgatttagctctacgctcagggcacgaccggtgctcgatttagtgtcgtcgcaagagagaggggggctgtgggtccaggaggcagaactctgggtgtctcaccatggcctggatccctntacttctccccctctcactctctgcacaggctctgacggcctctatgagctgacacacgccacccgtggtntcagtcgccccaggacagcggccaggatcactgctcgtggagatgcattcgaccaaacgatatcgtacttagttgtaccagacaagtaacgtccggcacgtccctggtcgttggtgatagtaataaagacacgtgacggacgtccctagacggactccgagacgcgtattctgtcgtctcgaggtcgacgggaactaacggtcatagttcgacctatcgtaggtgacgtccgaggacgaggacggacggaagtcgtagtactagtttatagtactaaactacgaaacgtacgaactaccctagtttacgttaaacttgttacgtacgtttacggaacgtcggtaaccgg

SEQ ID NO: 262358 - DNA, 154 bp, Homo sapiens; identical to SEQ ID NO: 262231
  misc_feature: GYAE6OF01BWRXR.51.73.G07.1.454.CMB.1.raw
  modified_base (153)..(154): a, c, t, g, unknown or other
  misc_feature (153)..(154): n is a, c, g, or t

SEQ ID NO: 262359 - DNA, 210 bp, Homo sapiens
  misc_feature: GYAE6OF01AL3YO.51.73.G07.1.454.CMB.1.raw
  modified_base (179)..(179): a, c, t, g, unknown or other
  misc_feature (179)..(179): n is a, c, g, or t
  modified_base (185)..(210): a, c, t, g, unknown or other
  misc_feature (185)..(210): n is a, c, g, or t
tcagcgatcgtatacacgaccggtgctcgatttagctctacgctcagggcacgaccggtgctcgatttagctctacgctcagggcacgaccggtgctcaatttagagtgctacgaagggaaggcagcgtcactctgttcccacctcctctcgtagcactctgagcgggctggcaaggcncatagnnnnnnnnnnnnnnnnnnnnnnnnnn

SEQ ID NO: 262360 - DNA, 229 bp, Homo sapiens
  misc_feature: GYAE6OF01AU0TC.51.73.G07.1.454.CMB.1.raw
  modified_base (222)..(229): a, c, t, g, unknown or other
  misc_feature (222)..(229): n is a, c, g, or t
tcagcgatcgtatacacgaccggtgctcgatttagctctacgctcaggcacgaccggtgctcgatttagtcgagctctctcgcggacgaccggtgctcgattagtcgagctctctcgcgggcacgaccggtgctcgatttagagtgctacgaaggaagggcagcgtcgactctgttcccacctcctctcgtagcactctgagcggctggcaaggcgcatagnnnnnnnn

SEQ ID NO: 262361 - DNA, 189 bp, Homo sapiens
  misc_feature: GYAE6OF01DHR9F.51.73.G07.1.454.CMB.1.raw
  modified_base (187)..(189): a, c, t, g, unknown or other
  misc_feature (187)..(189): n is a, c, g, or t
tcagcgatcgtatacacgaccggtgctcgatttagctctacgctcagggcacgaccggtgctcgatttagctctacgctcagggccacgaccggtgctcgatttacgagtgctacgaagggaaggcagcgtcactctgttcccacctcctctcgtagcactctgagcgggctggcaaggcgcatagnnn

SEQ ID NO: 262362 - DNA, 200 bp, Homo sapiens
  misc_feature: GYAE6OF01C4NKD.51.73.G07.1.454.CMB.1.raw
  modified_base (193)..(193): a, c, t, g, unknown or other
  misc_feature (193)..(193): n is a, c, g, or t
  modified_base (199)..(200): a, c, t, g, unknown or other
  misc_feature (199)..(200): n is a, c, g, or t
tcagcgatcgtatacacgaccggtgctcgatttagctctacgctcagggcacgaccggtgctcgatttagagtgctacgaagggaaaggcacgaccggtgctcgatttagagtgctaacgtaagggaaaggcagcgtcactctcgttccccacctcctctcgtagctactcgtgaggcgggctggacaaggcntatagnn

SEQ ID NO: 262363 - DNA, 199 bp, Homo sapiens
  misc_feature: GYAE6OF01C26N9.51.73.G07.1.454.CMB.1.raw
  modified_base (194)..(199): a, c, t, g, unknown or other
  misc_feature (194)..(199): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaaggcagcgtcactctcgttcccgccctcctctcgtagcactctgagcgggctggcaaggcgcatagnnnnnn

SEQ ID NO: 262364 - DNA, 742 bp, Homo sapiens
  misc_feature: GYAE6OF01DVL5J.51.73.G07.1.454.CMB.1.raw
  modified_base (253)..(253): a, c, t, g, unknown or other
  misc_feature (253)..(253): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaacgcccagctcagcttctcttcctcctgctactctggcctccagactaccagtacggggaaactgtgtagacacacgtcctccagcccacccttgttctttcgtccgtaccggaagggggaanacgcccaccctctccgtcggcgtacgggcctaggtcgaagtagttattacgactattcttcgttcggccttacggaaccaacgaacggaaccgtcggaccctacggtcccctaccccgacttacctnttaacttttagngtactcgactaacgtaaccggtaaagggttcgtcggactacgtccgacgtacgtaggtcgaagggtcggacgtagggttcggtacgtacgggaacttaacggtaacttcaaccgtttcaccgtaacctactaacccacgtaacgtaacgaacgtacgtaccgttaggtaaacgtttcgttttaacggtacttttaaggttttacttaacggtcgttacgaacgtacgtaacgggttacctaacgtacggttagtcccgttcggttaccggttacgggaaccgggtagggtaaccgtaggggtacgaacgtaactaaccggttaacggacgtcgggtacgtccgtaaccgg

SEQ ID NO: 262365 - DNA, 159 bp, Homo sapiens
  misc_feature: GYAE6OF01DREW0.51.73.G07.1.454.CMB.1.raw
  modified_base (153)..(159): a, c, t, g, unknown or other
  misc_feature (153)..(159): n is a, c, g, or t
tcagcgatcgtatacacgaccggtgctcgatttagctctacgctcagggcacgaccggtgctcgatttagagtgctacgaagggaaagggcagcgtcactctgttcccaccctctctcgtagcactctgagcgggctggacaaggcgcatagnnnnnnn

SEQ ID NO: 262366 - DNA, 153 bp, Homo sapiens; identical to SEQ ID NO: 262346
  misc_feature: GYAE6OF01DZR3A.51.73.G07.1.454.CMB.1.raw
  modified_base (152)..(153): a, c, t, g, unknown or other
  misc_feature (152)..(153): n is a, c, g, or t

SEQ ID NO: 262367 - DNA, 152 bp, Homo sapiens; identical to SEQ ID NO: 262308
  misc_feature: GYAE6OF01ASS0N.51.73.G07.1.454.CMB.1.raw

SEQ ID NO: 262368 - DNA, 150 bp, Homo sapiens
  misc_feature: GYAE6OF01DBS9H.51.73.G07.1.454.CMB.1.raw
tcagcgatcgtatacacgaccggtgctcgatttagctctacgctcagggcacgaccggtgctcgatttagagtgctacgaagggaaaggcagcgtcactctgttcccaccctcctctcgtagcactcgagcgggctggcaaggcgcatag

SEQ ID NO: 262369 - DNA, 157 bp, Homo sapiens
  misc_feature: GYAE6OF01BSO6E.51.73.G07.1.454.CMB.1.raw
  modified_base (153)..(157): a, c, t, g, unknown or other
  misc_feature (153)..(157): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnn

SEQ ID NO: 262370 - DNA, 298 bp, Homo sapiens
  misc_feature: GYAE6OF01EQVJE.51.73.G07.1.454.CMB.1.raw
  modified_base (292)..(298): a, c, t, g, unknown or other
  misc_feature (292)..(298): n is a, c, g, or t
tcagcgatcgtatacacgaccggtgctcgatttagctctacgctcagggcacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctggtccactctcgttccccgcctatctgatcgtagcactctggagcgggctggcaaggcgcaatgcnnnnnnn

SEQ ID NO: 262371 - DNA, 657 bp, Homo sapiens
  misc_feature: GYAE6OF01DOZH1.51.73.G07.1.454.CMB.1.raw
  modified_base (148)..(148): a, c, t, g, unknown or other
  misc_feature (148)..(148): n is a, c, g, or t
  modified_base (236)..(236): a, c, t, g, unknown or other
  misc_feature (236)..(236): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttcncttcctcctgctactctggctcccagataccatcggggaaactgtgttgacacagtctccagccacctgtctttgtctccaggggaangccaccctctcctgcaggggccagtgagagtattgacatcttcttggcctggtaccaacagaaacctggaccaggcctccccgactcctcatttactgatgcataccaaaaggggtcgttaggcactcccagcctaggtcaagtcggcgaggtgggtccgtaggggtaccaaggtaacttccaacgttcctaccaacccacttaccgaacccagaccttaaggaacgccctaggaacgttagtttttacgaccttaaggttttaattaaccgttgtacgtacggctaacggtacgtaaaccgtaacctcgggtcccttacgttcggtttcccggggaaccgggtacggggaaccggtaaaggggttacgggaacgtaacgttaccgaaaaaccggtacgtacgggttgggccgttaaccgg

SEQ ID NO: 262372 - DNA, 161 bp, Homo sapiens
  misc_feature: GYAE6OF01CYD7U.51.73.G07.1.454.CMB.1.raw
  modified_base (153)..(161): a, c, t, g, unknown or other
  misc_feature (153)..(161): n is a, c, g, or t
tcagcgatcgtatacacgaccggtgctcgatttagctctacgctcagggcacgaccggtgctcgatttagagtgctacgaagggaaaggcagcgtcactctgttcccacctcctctcgtagcactctgagcggctagggcaaggcgcaatagnnnnnnnnn

SEQ ID NO: 262373 - DNA, 288 bp, Homo sapiens
  misc_feature: GYAE6OF01CM9CJ.51.73.G07.1.454.CMB.1.raw
  modified_base (284)..(288): a, c, t, g, unknown or other
  misc_feature (284)..(288): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnnn

SEQ ID NO: 262374 - DNA, 182 bp, Homo sapiens
  misc_feature: GYAE6OF01B2ILB.51.73.G07.1.454.CMB.1.raw
  modified_base (154)..(182): a, c, t, g, unknown or other
  misc_feature (154)..(182): n is a, c, g, or t
tcagcgatcgtatacacgaccggtgctcgatttagctctacgctcagggcacgaccggtgctcgatttagagtgctacgaagggaaagggcagcgtcactcgtgttccccgccctcctctcgtagcactctgagcggctggcaaggcacatagnnnnnnnnnnnnnnnnnnnnnnnnnnnnn

SEQ ID NO: 262375 - DNA, 194 bp, Homo sapiens
  misc_feature: GYAE6OF01D1CD0.51.73.G07.1.454.CMB.1.raw
  modified_base (168)..(168): a, c, t, g, unknown or other
  misc_feature (168)..(168): n is a, c, g, or t
  modified_base (183)..(183): a, c, t, g, unknown or other
  misc_feature (183)..(183): n is a, c, g, or t
  modified_base (188)..(194): a, c, t, g, unknown or other
  misc_feature (188)..(194): n is a, c, g, or t
tcagcgatcgtatacacgaccggtgctcgatttagctctacgctcagggcacgaccggtgctcgatttagctctacgctcgaagggcacgaccggtgctcgatttacgagtgctacggaagggaaggcagcgtcactctcgttcccacctcctctcgtagcactctgngcgggctggcaggcncatgnnnnnnn

SEQ ID NO: 262376 - DNA, 165 bp, Homo sapiens
  misc_feature: GYAE6OF01BHYJO.51.73.G07.1.454.CMB.1.raw
  modified_base (162)..(165): a, c, t, g, unknown or other
  misc_feature (162)..(165): n is a, c, g, or t
tcagcgatcgtatacacgaccggtgctcgatttagctctacgctcagggcacgaccggtgctcgatttagtcgatagtgaagggaaagggggctggccctgacgtgtttctgttcccgccctcctctcgtagcactctgagcgggctggcaaggcgcatagnnnn

SEQ ID NO: 262377 - DNA, 216 bp, Homo sapiens
  misc_feature: GYAE6OF01A8MTA.51.73.G07.1.454.CMB.1.raw
  modified_base (130)..(130): a, c, t, g, unknown or other
  misc_feature (130)..(130): n is a, c, g, or t
  modified_base (156)..(156): a, c, t, g, unknown or other
  misc_feature (156)..(156): n is a, c, g, or t
  modified_base (185)..(185): a, c, t, g, unknown or other
  misc_feature (185)..(185): n is a, c, g, or t
  modified_base (190)..(216): a, c, t, g, unknown or other
  misc_feature (190)..(216): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaggcagcgtnactctgttcccaccctcctctcgtancactctggacgcgggctggccaaggccgnatagnnnnnnnnnnnnnnnnnnnnnnnnnnn

SEQ ID NO: 262378 - DNA, 175 bp, Homo sapiens
  misc_feature: GYAE6OF01DB367.51.73.G07.1.454.CMB.1.raw
  modified_base (129)..(129): a, c, t, g, unknown or other
  misc_feature (129)..(129): n is a, c, g, or t
  modified_base (150)..(150): a, c, t, g, unknown or other
  misc_feature (150)..(150): n is a, c, g, or t
  modified_base (156)..(175): a, c, t, g, unknown or other
  misc_feature (156)..(175): n is a, c, g, or t
tcagcgatcgtatacacgaccggtgctcgatttagctctacgctcagggcacgaccggtgctcgatttagagtgctaacggaagggaaaggcagcgtcactctcgtcccgcctctctcgtagcactcgngaggcgggctggacgaaggcnataggnnnnnnnnnnnnnnnnnnnn

SEQ ID NO: 262379 - DNA, 833 bp, Homo sapiens
  misc_feature: GYAE6OF01EOOHK.51.73.G07.1.454.CMB.1.raw
tcagcgatcgtatacacgaccggtgctcgatttagctctacgctcagggcacgaccggtgctcgatttagtacacgtgattagggattgggggagaactgctcagttaggacccagacgggaaccagtggaacgcccagctcagtcttcctcttcctcctgcttactcgtcggcctcccagactaccagtacgggaactgtagtagacacgtcgtcctaccacgccctacccgttgttcttttcgtaccgtaccggaagggggaacaccgccctaccctctccgcgacggacggccagtcgagtagttagttcgactcttcgttcgtcgtaccgtacgaaccaacgtacgaaccgtcggacccgacggtcccctcccgtacccttacctattaacgtttactagacttaccgacttaacgtaaccggtaaacgggttcgtaggacctaccgtacgtaccgtaccggtaggttcgaggttcggacggtacgggttacgggttaggttaacgggaacttaacgtacctccgtacttacccgtaactaccccgtacaacccgacgtaacggttaacctacggtacgtaccgtttaagggtaacctttcggttttacgtaacgttttaacgttttaacgttaaccgtcggttaaccaacggttaacgtaacccgttaaccgtttaaccgtacgtttaccgggttccgtttacccgggttaaggttccccgggggaaacggggttaacggtaaaacccgggttgggggtaaccggttaaaacgtaaccggtaaacccggtaaacggtacgggtttacggtacggttaccccggtaccg

SEQ ID NO: 262380 - DNA, 329 bp, Homo sapiens
  misc_feature: GYAE6OF01D3NTL.51.73.G07.1.454.CMB.1.raw
  modified_base (297)..(329): a, c, t, g, unknown or other
  misc_feature (297)..(329): n is a, c, g, or t
tcagcgatcgtatacacgaccggtgctcgatttagctctacgctcagggcacgaccggtgctcgatttagagctcacgtattggggggcaaaagctgccctgaccctttcgggtgcgcagcctgaggatgaggctgagtattactgcttgctctcctatagtggtgttcggtgttcggcggaggaccaagctgaccgtctagtcagcccaaggcctcgcccctcgtcactctcgttcccgcctatctgatcgtagcctactgtggaggcgggtcgtaggacaaggcgtcaatagcannnnnnnnnnnnnnnnnnnnnnnnnnnnnnnnn

SEQ ID NO: 262381 - DNA, 287 bp, Homo sapiens
  misc_feature: GYAE6OF01BD8I3.51.73.G07.1.454.CMB.1.raw
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (281)..(287): a, c, t, g, unknown or other
  misc_feature (281)..(287): n is a, c, g, or t
tcagcgatcgtatacacgaccggtgctcgatttagctctacgctcagggcacgaccggtgctcgatttagagctcacgtattggggggcaaagctgccctgaccctttcgggtgcgcagcctgaggatgaggctgagtattactgcttgctctctatagtggtgttcgggtgttcggcggaggaccaagctgaccgtctaggtcagcccaaggctcgcccctggtcactctgttcccgcatctgatcgtancactctcgagcggntggcaagcgcaatgcnnnnnnn

SEQ ID NO: 262382 - DNA, 186 bp, Homo sapiens
  misc_feature: GYAE6OF01CGWNC.51.73.G07.1.454.CMB.1.raw
  modified_base (157)..(186): a, c, t, g, unknown or other
  misc_feature (157)..(186): n is a, c, g, or t
tcagcgatcgtatacacgaccggtgctcgatttagctctacgctcaggggcacgaccggtgctcgatttagagtgctacgaagggaagggcagcgtcactctgttcccgccctcctctcgtagcactctggagcgggctgggcaagggtcgcatagnnnnnnnnnnnnnnnnnnnnnnnnnnnnnn

SEQ ID NO: 262383 - DNA, 195 bp, Homo sapiens
  misc_feature: GYAE6OF01A903B.51.73.G07.1.454.CMB.1.raw
  modified_base (187)..(195): a, c, t, g, unknown or other
  misc_feature (187)..(195): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaagggcagcgtcactctgttcccgccctcctctcgtagcactctgagcggctggcaaggcgcatagnnnnnnnnn

SEQ ID NO: 262384 - DNA, 317 bp, Homo sapiens
  misc_feature: GYAE6OF01A2D5K.51.73.G07.1.454.CMB.1.raw
  modified_base (180)..(180): a, c, t, g, unknown or other
  misc_feature (180)..(180): n is a, c, g, or t
  modified_base (297)..(317): a, c, t, g, unknown or other
  misc_feature (297)..(317): n is a, c, g, or t
tcagcgatcgtatacacgaccggtgctcgatttagctctacgctcagggcacgaccggtgctcgatttagagctcacgtattggggggcaaagctgcccctgaccctttcgggtgcgcagcctgaggatgaggctgagtattactgcttgctctcctatagtggtggttcggtgttcggnggagggaccaagctgaccgtctaggtcacgccaggctcgcccctcggtcactctcgtcccgcatctgatcgtacgctactcgtaggacggcgggactggacgaaggtcgacagtagnnnnnnnnnnnnnnnnnnnnn

SEQ ID NO: 262385 - DNA, 689 bp, Homo sapiens
  misc_feature: GYAE6OF01DKK21.51.73.G07.1.454.CMB.1.raw
  modified_base (204)..(204): a, c, t, g, unknown or other
  misc_feature (204)..(204): n is a, c, g, or t
  modified_base (681)..(681): a, c, t, g, unknown or other
  misc_feature (681)..(681): n is a, c, g, or t
tcagcgatcgtatacacgaccggtgctcgatttagctctacgctcagggcacgaccggtgctcgatttagtacacgtgattagggattgggggaggaactgctcagttaggacccagaggaaccatggaacgccccagctcagcttctcttcctcctgctactctggctcccagataccagtcggggaaactgtgttgacacgngtctccacgccaccctgttactttcgtctccgaaggggaaacacgcccaccctctaccgtgacgtagggccaagtgagtagtattgaactattcttcgttacggccttaggtaaccaaacgagtaaaccgtcggaccacggtccctccccgtacctcttaccaatttagacgtagtcacgtaactaaccggtaaaaggggttcgtttacggacctaacgtccctaacggtacccgtaggttaccgagttcgggaccgtaggttacggggtactaggggtaactaacggtaacttaccaacttccgtaccacctacgtaccaacgacgtaacgtaggaccgtacgtaagggtaattacgtttacgaccgttagtttaacttaccgtataccgtagacgtacgtaacgtactaacgtgtacctcgtcgttcgggacggtacggaacgtacggagacgaacttaacaaacgacgtacggngccgtacg

SEQ ID NO: 262386 - DNA, 704 bp, Homo sapiens
  misc_feature: GYAE6OF01EPVPX.51.73.G07.1.454.CMB.1.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
tcagcgatcgtatacacgaccggtgctcgatttagctctacgctcagggcacgaccggtgctcgattttagtacacgtgattagggattgggggaggaactgctcagttaggacccagagggaaccatggaagccccagctcagcttctcttcctcctgctactctggcctcccagataccagtaccggggaaactgtgttagacacagtcctccagccacctgttctttgtctcgaggggaaancgcccaccctctccngcgaggccagtganagtatgacattcttcgttggaccgttggtaacctaaacaacggaaaccgtcgggacccaacggggtccctacccccggtaccttcccttacctaactttttagtacgtatcggctaacgttaaccggtaaaggggttcggtttacggacctaacgttccccgaacgtcccgtacggttacgaacggttcggacgtagggtgggttacgtggacgtaaggtacttacacctcgttacccacgtaactacaccgagtaactacgagtcctagtaacgtgtttttacgacgttaagttttactaaccgtagttacgagtacctaacgtaaccgtaaccgtaacggtgtaccgtttcgttcccggttacgggaccggtaagggaccggttaagggtacgaagtacgtaacggaactacggtagtcggacgtacg

SEQ ID NO: 262387 - DNA, 158 bp, Homo sapiens
  misc_feature: GYAE6OF01BC3F7.51.73.G07.1.454.CMB.1.raw
  modified_base (155)..(158): a, c, t, g, unknown or other
  misc_feature (155)..(158): n is a, c, g, or t
tcagcgatcgtatacacgaccggtgctcgatttagctctacgctcagggcacgaccggtgctcgatttagagtgctacgaagggaaagggcagcgtcactctcgttcccaccctcctctcgtagcactctgaggcgggctggcaaggcgcatagnnnn

SEQ ID NO: 262388 - DNA, 152 bp, Homo sapiens; identical to SEQ ID NO: 262244
  misc_feature: GYAE6OF02GSC88.51.73.G07.1.454.CMB.1.raw
  modified_base (152)..(152): a, c, t, g, unknown or other
  misc_feature (152)..(152): n is a, c, g, or t

SEQ ID NO: 262389 - DNA, 193 bp, Homo sapiens
  misc_feature: GYAE6OF02F9PBQ.51.73.G07.1.454.CMB.1.raw
  modified_base (188)..(193): a, c, t, g, unknown or other
  misc_feature (188)..(193): n is a, c, g, or t
tcagcgatcgtatacacgaccggtgctcgatttagctctacgctcagggcacgaccggtgctcgattagagtgctacgaagggaagggcacgaccggtgctcgattagagtgctacgaagggaaggcagcgtcactctgttcccacctcctctcgtagcactctgagcgggctggcaaggcgcatagnnnnnn

SEQ ID NO: 262390 - DNA, 153 bp, Homo sapiens; identical to SEQ ID NO: 262214
  misc_feature: GYAE6OF02FWYT0.51.73.G07.1.454.CMB.1.raw
  modified_base (152)..(153): a, c, t, g, unknown or other
  misc_feature (152)..(153): n is a, c, g, or t

SEQ ID NO: 262391 - DNA, 192 bp, Homo sapiens
  misc_feature: GYAE6OF02GRDZH.51.73.G07.1.454.CMB.1.raw
  modified_base (185)..(192): a, c, t, g, unknown or other
  misc_feature (185)..(192): n is a, c, g, or t
tcagcgatcgtatacacgaccggtgctcgatttagctctacgctcaggcacgaccggtgctcgatttagtcctacgctcagggcacgaccggtgctcgatttagagtgctacgaaggaagggcagcgtcactctgttcccgccctcctctcgtagcactctgagcgggctggcaaggcgcatagnnnnnnnn

SEQ ID NO: 262392 - DNA, 155 bp, Homo sapiens
  misc_feature: GYAE6OF02HNG11.51.73.G07.1.454.CMB.1.raw
  modified_base (152)..(155): a, c, t, g, unknown or other
  misc_feature (152)..(155): n is a, c, g, or t
tcagcgatcgtatacacgaccggtgctcgatttagctctacgctcagggcacgaccggtgctcgatttagctgtgcgtcgaagggaaaggcagcgtcactctgttcccgcctcctctcgtagcactctgagcgggctggcaaggcgcatagnnnn

SEQ ID NO: 262393 - DNA, 176 bp, Homo sapiens
  misc_feature: GYAE6OF02F62QB.51.73.G07.1.454.CMB.1.raw
  modified_base (154)..(176): a, c, t, g, unknown or other
  misc_feature (154)..(176): n is a, c, g, or t
tcagcgatcgtatacacgaccggtgctcgatttagctctacgctcagggcacgaccggtgctcgagtttagagtgctacgaagggaaagggcagcgtcactctgttcccaccctcctctcgtagcactctgagcgggctggcaaggcgcatagnnnnnnnnnnnnnnnnnnnnnnn

SEQ ID NO: 262394 - DNA, 154 bp, Homo sapiens; identical to SEQ ID NO: 262231
  misc_feature: GYAE6OF02GWN8T.51.73.G07.1.454.CMB.1.raw
  modified_base (153)..(154): a, c, t, g, unknown or other
  misc_feature (153)..(154): n is a, c, g, or t

SEQ ID NO: 262395 - DNA, 193 bp, Homo sapiens
  misc_feature: GYAE6OF02GEXMI.51.73.G07.1.454.CMB.1.raw
  modified_base (191)..(193): a, c, t, g, unknown or other
  misc_feature (191)..(193): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaggcagcgtcactctgttcccacctcctctcgtagcactctgagcgggctggcaaggcgcatagnnn

SEQ ID NO: 262396 - DNA, 153 bp, Homo sapiens; identical to SEQ ID NO: 262219
  misc_feature: GYAE6OF02GIAYW.51.73.G07.1.454.CMB.1.raw
  modified_base (153)..(153): a, c, t, g, unknown or other
  misc_feature (153)..(153): n is a, c, g, or t

SEQ ID NO: 262397 - DNA, 153 bp, Homo sapiens; identical to SEQ ID NO: 262219
  misc_feature: GYAE6OF02FV5Z3.51.73.G07.1.454.CMB.1.raw
  modified_base (153)..(153): a, c, t, g, unknown or other
  misc_feature (153)..(153): n is a, c, g, or t

SEQ ID NO: 262398 - DNA, 187 bp, Homo sapiens
  misc_feature: GYAE6OF02I7JGC.51.73.G07.1.454.CMB.1.raw
  modified_base (186)..(187): a, c, t, g, unknown or other
  misc_feature (186)..(187): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaggcagcgtcactctgttcccgccctcctctcgtagcactctgagcgggctggcaaggcgcatagnn

SEQ ID NO: 262399 - DNA, 152 bp, Homo sapiens
  misc_feature: GYAE6OF02II5BB.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaaagggcagcgtcactctgttcccgcctcctctcgtagcactctgagcgggctggcaaggcgcatagn

SEQ ID NO: 262400 - DNA, 284 bp, Homo sapiens
  misc_feature: GYAE6OF02GU4ZW.51.73.G07.1.454.CMB.1.raw
  modified_base (284)..(284): a, c, t, g, unknown or other
  misc_feature (284)..(284): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccgccatctgatcgtagcactctgagcgggctggcaaggcgcatagn

SEQ ID NO: 262401 - DNA, 152 bp, Homo sapiens
  misc_feature: GYAE6OF02FG69D.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagctgtgcgtcgaagggaagggcagcgtcactctgttcccacctcctctcgtagcactctgagcgggctggcaaggcgcatagn

SEQ ID NO: 262402 - DNA, 140 bp, Homo sapiens
  misc_feature: GYAE6OF02HQ3E8.51.73.G07.1.454.CMB.1.raw
  modified_base (140)..(140): a, c, t, g, unknown or other
  misc_feature (140)..(140): n is a, c, g, or t
tcagcgatcgtatacacgaccggtgctcgatttagctctacgctcagggcacgaccggtgctcgatttatccacgcccagagctcgaaacaccgcgccatctgatcgtagcactctgagcgggctggcaaggcgcatagn

SEQ ID NO: 262403 - DNA, 152 bp, Homo sapiens
  misc_feature: GYAE6OF02GMCHD.51.73.G07.1.454.CMB.1.raw
  modified_base (151)..(152): a, c, t, g, unknown or other
  misc_feature (151)..(152): n is a, c, g, or t
tcagcgatcgtatacacgaccggtgctcgatttagctctacgctcagggcacgaccggtgctcgatttagagtgctacgaagggaagggcagcgtcactctgttcccgcctcctctcgtagcactctgagcgggctggcaaggcgcatagnn

SEQ ID NO: 262404 - DNA, 155 bp, Homo sapiens; identical to SEQ ID NO: 262259
  misc_feature: GYAE6OF02JIJN5.51.73.G07.1.454.CMB.1.raw
  modified_base (153)..(155): a, c, t, g, unknown or other
  misc_feature (153)..(155): n is a, c, g, or t

SEQ ID NO: 262405 - DNA, 153 bp, Homo sapiens; identical to SEQ ID NO: 262219
  misc_feature: GYAE6OF02HZZF7.51.73.G07.1.454.CMB.1.raw
  modified_base (153)..(153): a, c, t, g, unknown or other
  misc_feature (153)..(153): n is a, c, g, or t

SEQ ID NO: 262406 - DNA, 157 bp, Homo sapiens
  misc_feature: GYAE6OF02I3FXI.51.73.G07.1.454.CMB.1.raw
  modified_base (156)..(157): a, c, t, g, unknown or other
  misc_feature (156)..(157): n is a, c, g, or t
tcagcgatcgtatacacgaccggtgctcgatttagctctacgctcagggcgacgaccggtgacgtcgatttagagtgctacgaagggaaagggcagcgtcactctgttcccaccctcctctcgtagcactctgagcgggctggcaaggcgcatagnn

SEQ ID NO: 262407 - DNA, 178 bp, Homo sapiens
  misc_feature: GYAE6OF02HX6BC.51.73.G07.1.454.CMB.1.raw
  modified_base (155)..(178): a, c, t, g, unknown or other
  misc_feature (155)..(178): n is a, c, g, or t
tcagcgatcgtatacacgaccggtgctcgatttagctctacgctcagggtcgacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnn

SEQ ID NO: 262408 - DNA, 152 bp, Homo sapiens; identical to SEQ ID NO: 262246
  misc_feature: GYAE6OF02IR42F.51.73.G07.1.454.CMB.1.raw

SEQ ID NO: 262409 - DNA, 169 bp, Homo sapiens
  misc_feature: GYAE6OF02IJAYI.51.73.G07.1.454.CMB.1.raw
  modified_base (152)..(169): a, c, t, g, unknown or other
  misc_feature (152)..(169): n is a, c, g, or t
tcagcgatcgtatacacgaccggtgctcgatttagctctacgctcaggggcgacgaccggtgctcgatttagagtgctacgaagggaaggcagcgtcactctgttcccgccctctctcgtagcactctgagcgggctggcaaggcgcatagnnnnnnnnnnnnnnnnnn

SEQ ID NO: 262410 - DNA, 166 bp, Homo sapiens
  misc_feature: GYAE6OF02IJNYY.51.73.G07.1.454.CMB.1.raw
  modified_base (153)..(166): a, c, t, g, unknown or other
  misc_feature (153)..(166): n is a, c, g, or t
tcagcgatcgtatacacgaccggtgctcgatttagctctacgctcagggcgacgaccggtgctcgatttagagtgctacgaagggaaagggcagcgtcactctgttcccgcctcctctcgtagcactctgagcgggctggcaaggcgcatagnnnnnnnnnnnnnn

SEQ ID NO: 262411 - DNA, 153 bp, Homo sapiens
  misc_feature: GYAE6OF02JCTW6.51.73.G07.1.454.CMB.1.raw
  modified_base (152)..(153): a, c, t, g, unknown or other
  misc_feature (152)..(153): n is a, c, g, or t
tcagcgatcgtatacacgaccggtgctcgatttagctctacgctcagggcacgaccggtgctcgatttagagtgctacgaagggaaagggcagcgtcactctgttcccacctcctctcgtagcactctgagcgggctggcaaggcgcatagnn

SEQ ID NO: 262412 - DNA, 154 bp, Homo sapiens; identical to SEQ ID NO: 262254
  misc_feature: GYAE6OF02H6FZZ.51.73.G07.1.454.CMB.1.raw
  modified_base (154)..(154): a, c, t, g, unknown or other
  misc_feature (154)..(154): n is a, c, g, or t

SEQ ID NO: 262413 - DNA, 155 bp, Homo sapiens; identical to SEQ ID NO: 262229
  misc_feature: GYAE6OF02HIORN.51.73.G07.1.454.CMB.1.raw
  modified_base (153)..(155): a, c, t, g, unknown or other
  misc_feature (153)..(155): n is a, c, g, or t

SEQ ID NO: 262414 - DNA, 154 bp, Homo sapiens; identical to SEQ ID NO: 262264
  misc_feature: GYAE6OF02FXI8A.51.73.G07.1.454.CMB.1.raw
  modified_base (153)..(154): a, c, t, g, unknown or other
  misc_feature (153)..(154): n is a, c, g, or t

SEQ ID NO: 262415 - DNA, 154 bp, Homo sapiens; identical to SEQ ID NO: 262231
  misc_feature: GYAE6OF02ITXJZ.51.73.G07.1.454.CMB.1.raw
  modified_base (153)..(154): a, c, t, g, unknown or other
  misc_feature (153)..(154): n is a, c, g, or t

SEQ ID NO: 262416 - DNA, 153 bp, Homo sapiens
  misc_feature: GYAE6OF02I3SBX.51.73.G07.1.454.CMB.1.raw
  modified_base (153)..(153): a, c, t, g, unknown or other
  misc_feature (153)..(153): n is a, c, g, or t
tcagcgatcgtatacacgaccggtgctcgatttagctctacgctcagggcacgaccggtgcccgatttagagtgctacgaagggaaagggcagcgtcactctgttcccaccctcctctcgtagcactctgagcgggctggcaaggcgcatagn

SEQ ID NO: 262417 - DNA, 153 bp, Homo sapiens; identical to SEQ ID NO: 262233
  misc_feature: GYAE6OF02HL5SY.51.73.G07.1.454.CMB.1.raw
  modified_base (153)..(153): a, c, t, g, unknown or other
  misc_feature (153)..(153): n is a, c, g, or t

SEQ ID NO: 262418 - DNA, 141 bp, Homo sapiens
  misc_feature: GYAE6OF02FIPRV.51.73.G07.1.454.CMB.1.raw
  modified_base (141)..(141): a, c, t, g, unknown or other
  misc_feature (141)..(141): n is a, c, g, or t
tcagcgatcgtatacacgaccggtgctcgatttagctctacgctcagggcacgaccggtgctcgatttatccacgcccagagctcgaaaacaccgcgccatctgatcgtagcactctgagcgggctggcaaggcgcatagn

SEQ ID NO: 262419 - DNA, 180 bp, Homo sapiens
  misc_feature: GYAE6OF02G3NKA.51.73.G07.1.454.CMB.1.raw
  modified_base (152)..(152): a, c, t, g, unknown or other
  misc_feature (152)..(152): n is a, c, g, or t
  modified_base (154)..(180): a, c, t, g, unknown or other
  misc_feature (154)..(180): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtacactctgagcgggctggcaaggcgcatagnannnnnnnnnnnnnnnnnnnnnnnnnnn

SEQ ID NO: 262420 - DNA, 154 bp, Homo sapiens; identical to SEQ ID NO: 262264
  misc_feature: GYAE6OF02F8JIH.51.73.G07.1.454.CMB.1.raw
  modified_base (153)..(154): a, c, t, g, unknown or other
  misc_feature (153)..(154): n is a, c, g, or t

SEQ ID NO: 262421 - DNA, 151 bp, Homo sapiens
  misc_feature: GYAE6OF02FFAYN.51.73.G07.1.454.CMB.1.raw
  modified_base (151)..(151): a, c, t, g, unknown or other
  misc_feature (151)..(151): n is a, c, g, or t
tcagcgatcgtatacacgaccggtgctcgatttagctctacgctcagggcacgaccggtgctcgattagagtgctacgaagggaaggcagcgtcactctcgttcccgccctcctctcgtagcactctgagcgggctggcaaggcgcatagn

SEQ ID NO: 262422 - DNA, 172 bp, Homo sapiens
  misc_feature: GYAE6OF02HREK4.51.73.G07.1.454.CMB.1.raw
  modified_base (153)..(172): a, c, t, g, unknown or other
  misc_feature (153)..(172): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnnnnnnnnnnnnnnnn

SEQ ID NO: 262423 - DNA, 152 bp, Homo sapiens
  misc_feature: GYAE6OF02HYU64.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagagtgctacgaagggaaagggcagcgtcactctgttcccacctcctctcgtagcactctgagcgggctggcaaggcgcatagn

SEQ ID NO: 262424 - DNA, 159 bp, Homo sapiens
  misc_feature: GYAE6OF02I1BFW.51.73.G07.1.454.CMB.1.raw
  modified_base (153)..(159): a, c, t, g, unknown or other
  misc_feature (153)..(159): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnnn

SEQ ID NO: 262425 - DNA, 153 bp, Homo sapiens; identical to SEQ ID NO: 262219
  misc_feature: GYAE6OF02HYCUX.51.73.G07.1.454.CMB.1.raw
  modified_base (153)..(153): a, c, t, g, unknown or other
  misc_feature (153)..(153): n is a, c, g, or t

SEQ ID NO: 262426 - DNA, 154 bp, Homo sapiens; identical to SEQ ID NO: 262264
  misc_feature: GYAE6OF02FH0DY.51.73.G07.1.454.CMB.1.raw
  modified_base (153)..(154): a, c, t, g, unknown or other
  misc_feature (153)..(154): n is a, c, g, or t

SEQ ID NO: 262427 - DNA, 188 bp, Homo sapiens
  misc_feature: GYAE6OF02G74V7.51.73.G07.1.454.CMB.1.raw
  modified_base (187)..(188): a, c, t, g, unknown or other
  misc_feature (187)..(188): n is a, c, g, or t
tcagcgatcgtatacacgaccggtgctcgatttagctctacgctcagggcacgaccggtgctcgatttagcgagacgcgcagggcacgaccggtgctcgatttagctgtgcgtcgaagggaaggcagcgtcactctgttcccgccctcctctcgtagcactctgagcgggctggcaaggcgcatagnn

SEQ ID NO: 262428 - DNA, 153 bp, Homo sapiens; identical to SEQ ID NO: 262219
  misc_feature: GYAE6OF02G6FBL.51.73.G07.1.454.CMB.1.raw
  modified_base (153)..(153): a, c, t, g, unknown or other
  misc_feature (153)..(153): n is a, c, g, or t

SEQ ID NO: 262429 - DNA, 153 bp, Homo sapiens; identical to SEQ ID NO: 262233
  misc_feature: GYAE6OF02H09L2.51.73.G07.1.454.CMB.1.raw
  modified_base (153)..(153): a, c, t, g, unknown or other
  misc_feature (153)..(153): n is a, c, g, or t

SEQ ID NO: 262430 - DNA, 154 bp, Homo sapiens; identical to SEQ ID NO: 262294
  misc_feature: GYAE6OF02G5SRO.51.73.G07.1.454.CMB.1.raw
  modified_base (154)..(154): a, c, t, g, unknown or other
  misc_feature (154)..(154): n is a, c, g, or t

SEQ ID NO: 262431 - DNA, 150 bp, Homo sapiens
  misc_feature: GYAE6OF02JP1M9.51.73.G07.1.454.CMB.1.raw
  modified_base (149)..(150): a, c, t, g, unknown or other
  misc_feature (149)..(150): n is a, c, g, or t
tcagcgatcgtatacacgaccggtgctcgatttagctctacgctcagggcgacgaccggtgacgtcgattagagtgctacgaggaaggcagcgtcactctgttcccacctcctctcgtagcactctgagcggctggcaaggcgcatagnn

SEQ ID NO: 262432 - DNA, 158 bp, Homo sapiens
  misc_feature: GYAE6OF02G9BA1.51.73.G07.1.454.CMB.1.raw
  modified_base (153)..(158): a, c, t, g, unknown or other
  misc_feature (153)..(158): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnnnnnn

SEQ ID NO: 262433 - DNA, 153 bp, Homo sapiens; identical to SEQ ID NO: 262219
  misc_feature: GYAE6OF02ICZPM.51.73.G07.1.454.CMB.1.raw
  modified_base (153)..(153): a, c, t, g, unknown or other
  misc_feature (153)..(153): n is a, c, g, or t

SEQ ID NO: 262434 - DNA, 159 bp, Homo sapiens
  misc_feature: GYAE6OF02HCFS1.51.73.G07.1.454.CMB.1.raw
  modified_base (155)..(159): a, c, t, g, unknown or other
  misc_feature (155)..(159): n is a, c, g, or t
tcagcgatcgtatacacgaccggtgctcgatttagctctacgctcagggcgacgaccggtgctcgatttagctgtgcgtcgaagggaaagggcagcgtcactctgttcccaccctcctctcgtagcactctgagcgggctggcaaggcgcatagnnnnn

SEQ ID NO: 262435 - DNA, 151 bp, Homo sapiens
  misc_feature: GYAE6OF02IMK6V.51.73.G07.1.454.CMB.1.raw
  modified_base (151)..(151): a, c, t, g, unknown or other
  misc_feature (151)..(151): n is a, c, g, or t
tcagcgatcgtatacacgaccggtgctcgatttagctctacgctcagggcacgaccggtgctcgatttatccacgcccagagctcgaaaacaccgttcatcttcccgccatctgatcgtagcactctgagcgggctggcaaggcgcatagn

SEQ ID NO: 262436 - DNA, 154 bp, Homo sapiens; identical to SEQ ID NO: 262264
  misc_feature: GYAE6OF02G7GTE.51.73.G07.1.454.CMB.1.raw
  modified_base (153)..(154): a, c, t, g, unknown or other
  misc_feature (153)..(154): n is a, c, g, or t

SEQ ID NO: 262437 - DNA, 184 bp, Homo sapiens
  misc_feature: GYAE6OF02F7D2H.51.73.G07.1.454.CMB.1.raw
  modified_base (145)..(184): a, c, t, g, unknown or other
  misc_feature (145)..(184): n is a, c, g, or t
tcagcgatcgtatacacgaccggtgctcgatttagctctacgctcagggcacgaccggtgctcgatttatccacgcccagagctcgaaacaccggcgccatctgatcgtagcacgttcgtgagcgggctggcaacggcgcatagnnnnnnnnnnnnnnnnnnnnnnnnnnnnnnnnnnnnnnnn

SEQ ID NO: 262438 - DNA, 154 bp, Homo sapiens; identical to SEQ ID NO: 262231
  misc_feature: GYAE6OF02GM787.51.73.G07.1.454.CMB.1.raw
  modified_base (153)..(154): a, c, t, g, unknown or other
  misc_feature (153)..(154): n is a, c, g, or t

SEQ ID NO: 262439 - DNA, 174 bp, Homo sapiens
  misc_feature: GYAE6OF02HOZG2.51.73.G07.1.454.CMB.1.raw
  modified_base (156)..(174): a, c, t, g, unknown or other
  misc_feature (156)..(174): n is a, c, g, or t
tcagcgatcgtatacacgaccggtgctcgatttagctctacgctcagggcgacgaccggtgctcgatttagagtgctacgaagggaagggcagcgtcactctgttcccaccctcctctcgtagcactctgagcgggctggccaagggcgacatagnnnnnnnnnnnnnnnnnnn

SEQ ID NO: 262440 - DNA, 154 bp, Homo sapiens
  misc_feature: GYAE6OF02FH9BW.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggcacgaccggtgctcgatttagtcgatagtgaagggaaagggcagcgtcactctgttcccaccctcctctcgtagcactctgagcgggctggcaaggcgcatagnn

SEQ ID NO: 262441 - DNA, 154 bp, Homo sapiens; identical to SEQ ID NO: 262231
  misc_feature: GYAE6OF02IFMGE.51.73.G07.1.454.CMB.1.raw
  modified_base (153)..(154): a, c, t, g, unknown or other
  misc_feature (153)..(154): n is a, c, g, or t

SEQ ID NO: 262442 - DNA, 152 bp, Homo sapiens
  misc_feature: GYAE6OF02FI5TP.51.73.G07.1.454.CMB.1.raw
  modified_base (152)..(152): a, c, t, g, unknown or other
  misc_feature (152)..(152): n is a, c, g, or t
tcagcgatcgtatacacgaccggtgctcgatttagctctacgctcagggcacgaccggtgctcgatttagctgtgcgtcgaagggaagggcagcgtcactctgttcccgcctcctctcgtagcactctgagcgggctggcaaggcgcatagn

SEQ ID NO: 262443 - DNA, 146 bp, Homo sapiens
  misc_feature: GYAE6OF02JN323.51.73.G07.1.454.CMB.1.raw
  modified_base (142)..(142): a, c, t, g, unknown or other
  misc_feature (142)..(142): n is a, c, g, or t
  modified_base (146)..(146): a, c, t, g, unknown or other
  misc_feature (146)..(146): n is a, c, g, or t
tcagcgatcgtatacacgaccggtgctcgatttagctctacgctcagggcacgaccggtgctcgatttagagtgctacgaaggaaggcagcgtcactctcgttcccgcctctctcgtagcactctgagcggctggcaaggcnatgn

SEQ ID NO: 262444 - DNA, 181 bp, Homo sapiens
  misc_feature: GYAE6OF02G3E8Z.51.73.G07.1.454.CMB.1.raw
  modified_base (166)..(181): a, c, t, g, unknown or other
  misc_feature (166)..(181): n is a, c, g, or t
tcagcgatcgtatacacgaccggtgctcgatttagctctacgctcagggcacgaccggtgctcgatttagagtgctacgaagggaaagggcagcgtcactctgttcccacactctgttcccaccctcctctcgtagcactctgagcgggctggcaaggcgcatagnnnnnnnnnnnnnnnn

SEQ ID NO: 262445 - DNA, 155 bp, Homo sapiens; identical to SEQ ID NO: 262229
  misc_feature: GYAE6OF02HW5D5.51.73.G07.1.454.CMB.1.raw
  modified_base (153)..(155): a, c, t, g, unknown or other
  misc_feature (153)..(155): n is a, c, g, or t

SEQ ID NO: 262446 - DNA, 282 bp, Homo sapiens
  misc_feature: GYAE6OF02F2C1E.51.73.G07.1.454.CMB.1.raw
  modified_base (231)..(242): a, c, t, g, unknown or other
  misc_feature (231)..(242): n is a, c, g, or t
  modified_base (244)..(244): a, c, t, g, unknown or other
  misc_feature (244)..(244): n is a, c, g, or t
  modified_base (246)..(282): a, c, t, g, unknown or other
  misc_feature (246)..(282): n is a, c, g, or t
tcagcgatcgtatacacgaccggtgctcgatttagctctacgctcagggcgacgaccggtgctcgatttagcctctacgctcagggcaccgaccggtgctcgatttagctctacgctcagggcacgaccggtgctcgatttacgagtgctacgtaagggaaaggcagcgtcacgtctgttcccaccctcctctcgtagcacgtctgagcgggcctggccaaggcgcatagnnnnnnnnnnnnanannnnnnnnnnnnnnnnnnnnnnnnnnnnnnnnnnnnn

SEQ ID NO: 262447 - DNA, 162 bp, Homo sapiens
  misc_feature: GYAE6OF02IFRA8.51.73.G07.1.454.CMB.1.raw
  modified_base (154)..(162): a, c, t, g, unknown or other
  misc_feature (154)..(162): n is a, c, g, or t
tcagcgatcgtatacacgaccggtgctcgatttagctctacgctcaggggcacgaccggtgctcgatttagagtgctacgaagggaaagggcagcgtcactctgttcccaccctcctctcgtagcactctgagcgggctggcaaggcgcatagnnnnnnnnn

SEQ ID NO: 262448 - DNA, 153 bp, Homo sapiens; identical to SEQ ID NO: 262233
  misc_feature: GYAE6OF02GWHJL.51.73.G07.1.454.CMB.1.raw
  modified_base (153)..(153): a, c, t, g, unknown or other
  misc_feature (153)..(153): n is a, c, g, or t

SEQ ID NO: 262449 - DNA, 153 bp, Homo sapiens; identical to SEQ ID NO: 262219
  misc_feature: GYAE6OF02H8Z0T.51.73.G07.1.454.CMB.1.raw
  modified_base (153)..(153): a, c, t, g, unknown or other
  misc_feature (153)..(153): n is a, c, g, or t

SEQ ID NO: 262450 - DNA, 154 bp, Homo sapiens; identical to SEQ ID NO: 262231
  misc_feature: GYAE6OF02GESZE.51.73.G07.1.454.CMB.1.raw
  modified_base (153)..(154): a, c, t, g, unknown or other
  misc_feature (153)..(154): n is a, c, g, or t

SEQ ID NO: 262451 - DNA, 154 bp, Homo sapiens; identical to SEQ ID NO: 262294
  misc_feature: GYAE6OF02IJE5D.51.73.G07.1.454.CMB.1.raw
  modified_base (154)..(154): a, c, t, g, unknown or other
  misc_feature (154)..(154): n is a, c, g, or t

SEQ ID NO: 262452 - DNA, 235 bp, Homo sapiens
  misc_feature: GYAE6OF02H8505.51.73.G07.1.454.CMB.1.raw
  modified_base (231)..(235): a, c, t, g, unknown or other
  misc_feature (231)..(235): n is a, c, g, or t
tcagcgatcgtatacacgaccggtgctcgatttagctctacgctcagggcacgaccggtgctcgatttagacagtatatatccgcgggcacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnnnn

SEQ ID NO: 262453 - DNA, 206 bp, Homo sapiens
  misc_feature: GYAE6OF02IZNWF.51.73.G07.1.454.CMB.1.raw
  modified_base (157)..(206): a, c, t, g, unknown or other
  misc_feature (157)..(206): n is a, c, g, or t
tcagcgatcgtatacacgaccggtgctcgatttagctctacgctcagggcgacgaccggtgctcgatttagcctgtgcgtcgaagggaaaggccagcgtcactctgttcccaccctcctctcgtagcactctgagcgggctggcaaggcgacatagnnnnnnnnnnnnnnnnnnnnnnnnnnnnnnnnnnnnnnnnnnnnnnnnnn

SEQ ID NO: 262454 - DNA, 227 bp, Homo sapiens
  misc_feature: GYAE6OF02IY5XN.51.73.G07.1.454.CMB.1.raw
  modified_base (161)..(161): a, c, t, g, unknown or other
  misc_feature (161)..(161): n is a, c, g, or t
  modified_base (163)..(168): a, c, t, g, unknown or other
  misc_feature (163)..(168): n is a, c, g, or t
  modified_base (170)..(227): a, c, t, g, unknown or other
  misc_feature (170)..(227): n is a, c, g, or t
tcagcgatcgtatacacgaccggtgctcgatttagctctacgctcaagggcacggaccggtgctcgatttaggagtgctacgaagggaaagggcagcgttcactctgttcccgccctcctctcgtagcactctggagcgggctgggcaagggccgcatagncnnnnnngnnnnnnnnnnnnnnnnnnnnnnnnnnnnnnnnnnnnnnnnnnnnnnnnnnnnnnnnnn

SEQ ID NO: 262455 - DNA, 249 bp, Homo sapiens
  misc_feature: GYAE6OF02GDM1N.51.73.G07.1.454.CMB.1.raw
  modified_base (163)..(163): a, c, t, g, unknown or other
  misc_feature (163)..(163): n is a, c, g, or t
  modified_base (166)..(167): a, c, t, g, unknown or other
  misc_feature (166)..(167): n is a, c, g, or t
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (174)..(176): a, c, t, g, unknown or other
  misc_feature (174)..(176): n is a, c, g, or t
  modified_base (178)..(249): a, c, t, g, unknown or other
  misc_feature (178)..(249): n is a, c, g, or t
tcagcgatcgtatacacgaccggtgctcgatttagctctacgctctagggacgacgaccggtggctcggatttagagtgctacgaagggaaagggcagccgtcactctgttcccgcccgtcctctcgtagcactctgagcgggctgggcaaagggcgcatagngtnntncntannncnnnnnnnnnnnnnnnnnnnnnnnnnnnnnnnnnnnnnnnnnnnnnnnnnnnnnnnnnnnnnnnnnnnnnnnn

SEQ ID NO: 262456 - DNA, 153 bp, Homo sapiens; identical to SEQ ID NO: 262233
  misc_feature: GYAE6OF02F786A.51.73.G07.1.454.CMB.1.raw
  modified_base (153)..(153): a, c, t, g, unknown or other
  misc_feature (153)..(153): n is a, c, g, or t

SEQ ID NO: 262457 - DNA, 190 bp, Homo sapiens
  misc_feature: GYAE6OF02GF7EP.51.73.G07.1.454.CMB.1.raw
  modified_base (158)..(190): a, c, t, g, unknown or other
  misc_feature (158)..(190): n is a, c, g, or t
tcagcgatcgtatacacgaccggtgctcgatttagctctacgctcagggcacgaccgggtgctcgatttagagtgcctacgaagggaaaggcagcgtccactctgttcccgcccttcctctccgtagcactctgagcgggcctggcaaggcgcatagnnnnnnnnnnnnnnnnnnnnnnnnnnnnnnnnn

SEQ ID NO: 262458 - DNA, 155 bp, Homo sapiens; identical to SEQ ID NO: 262329
  misc_feature: GYAE6OF02FGS7W.51.73.G07.1.454.CMB.1.raw
  modified_base (154)..(155): a, c, t, g, unknown or other
  misc_feature (154)..(155): n is a, c, g, or t

SEQ ID NO: 262459 - DNA, 153 bp, Homo sapiens; identical to SEQ ID NO: 262233
  misc_feature: GYAE6OF02FX0KZ.51.73.G07.1.454.CMB.1.raw
  modified_base (153)..(153): a, c, t, g, unknown or other
  misc_feature (153)..(153): n is a, c, g, or t

SEQ ID NO: 262460 - DNA, 189 bp, Homo sapiens
  misc_feature: GYAE6OF02HUSC5.51.73.G07.1.454.CMB.1.raw
  modified_base (188)..(189): a, c, t, g, unknown or other
  misc_feature (188)..(189): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnn

SEQ ID NO: 262461 - DNA, 179 bp, Homo sapiens
  misc_feature: GYAE6OF02HCHEL.51.73.G07.1.454.CMB.1.raw
  modified_base (154)..(179): a, c, t, g, unknown or other
  misc_feature (154)..(179): n is a, c, g, or t
tcagcgatcgtatacacgaccggtgctcgatttagctctacgctcaggggcacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnn

SEQ ID NO: 262462 - DNA, 172 bp, Homo sapiens
  misc_feature: GYAE6OF02HQTR4.51.73.G07.1.454.CMB.1.raw
  modified_base (152)..(172): a, c, t, g, unknown or other
  misc_feature (152)..(172): n is a, c, g, or t
tcagcgatcgtatacacgaccggtgctcgatttagctctacgctcagggcgacgaccgggtgctcgatttagagtgctacgaagggaaagggcagcgtcactctcccgcctcctctccgtagcactctgagcgggctggcaaggcgcatagnnnnnnnnnnnnnnnnnnnnn

SEQ ID NO: 262463 - DNA, 153 bp, Homo sapiens; identical to SEQ ID NO: 262233
  misc_feature: GYAE6OF02F8RP0.51.73.G07.1.454.CMB.1.raw
  modified_base (153)..(153): a, c, t, g, unknown or other
  misc_feature (153)..(153): n is a, c, g, or t

SEQ ID NO: 262464 - DNA, 289 bp, Homo sapiens
  misc_feature: GYAE6OF02IWHYF.51.73.G07.1.454.CMB.1.raw
  modified_base (283)..(289): a, c, t, g, unknown or other
  misc_feature (283)..(289): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctggtcactctgttcccgccatctgatcgtagcactctgagcgggctggcaaggcgcatagnnnnnnn

SEQ ID NO: 262465 - DNA, 155 bp, Homo sapiens
  misc_feature: GYAE6OF02HX2OB.51.73.G07.1.454.CMB.1.raw
  modified_base (154)..(155): a, c, t, g, unknown or other
  misc_feature (154)..(155): n is a, c, g, or t
tcagcgatcgtatacacgaccggtgctcgatttagctctacgctcagggcacgaccggtgctcgatttaggagtgctacgaagggaaagggcagcgtcactctgttcccgccctcctctcgtagcactctgagcgggctggcaaggcgcatagnn

SEQ ID NO: 262466 - DNA, 153 bp, Homo sapiens; identical to SEQ ID NO: 262219
  misc_feature: GYAE6OF02GV5FU.51.73.G07.1.454.CMB.1.raw
  modified_base (153)..(153): a, c, t, g, unknown or other
  misc_feature (153)..(153): n is a, c, g, or t

SEQ ID NO: 262467 - DNA, 154 bp, Homo sapiens
  misc_feature: GYAE6OF02FMKXI.51.73.G07.1.454.CMB.1.raw
  modified_base (153)..(154): a, c, t, g, unknown or other
  misc_feature (153)..(154): n is a, c, g, or t
tcagcgatcgtatacacgaccggtgctcgatttagctctacgctcagggaacgaccggtgctcgatttagagtgctacgaagggaaagggcagcgtcactctgttcccaccctcctctcgtagcactctgagcgggctggcaaggcgcatagnn

SEQ ID NO: 262468 - DNA, 153 bp, Homo sapiens; identical to SEQ ID NO: 262233
  misc_feature: GYAE6OF02HKTG3.51.73.G07.1.454.CMB.1.raw
  modified_base (153)..(153): a, c, t, g, unknown or other
  misc_feature (153)..(153): n is a, c, g, or t

SEQ ID NO: 262469 - DNA, 168 bp, Homo sapiens
  misc_feature: GYAE6OF02G1O6T.51.73.G07.1.454.CMB.1.raw
  modified_base (154)..(168): a, c, t, g, unknown or other
  misc_feature (154)..(168): n is a, c, g, or t
tcagcgatcgtatacacgaccggtgctcgatttagctctacgctcagggcgacgaccggtgctcgatttagagtgctacgaagggaaagggcagcgtcactctgttcccaccctcctctcgtagcactctgagcgggctggcaaggcgcatagnnnnnnnnnnnnnnn

SEQ ID NO: 262470 - DNA, 523 bp, Homo sapiens
  misc_feature: GYAE6OF02GJOU5.51.73.G07.1.454.CMB.1.raw
  modified_base (238)..(238): a, c, t, g, unknown or other
  misc_feature (238)..(238): n is a, c, g, or t
  modified_base (520)..(520): a, c, t, g, unknown or other
  misc_feature (520)..(520): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggctccccgactcctcatttatgatgcatccaaaagggtcgttggcatccagccaggttcagtggcagtggtctgggacagaattcactctcaccatcaccagactagagcctagaagattttgctagtttattacttgtcagcagcgtaacaactgcttctctttcggcggtacggaccgaaggtggagacgtacaaacggactgtcggntcg

SEQ ID NO: 262471 - DNA, 153 bp, Homo sapiens; identical to SEQ ID NO: 262233
  misc_feature: GYAE6OF02HWOAZ.51.73.G07.1.454.CMB.1.raw
  modified_base (153)..(153): a, c, t, g, unknown or other
  misc_feature (153)..(153): n is a, c, g, or t

SEQ ID NO: 262472 - DNA, 155 bp, Homo sapiens
  misc_feature: GYAE6OF02F40XD.51.73.G07.1.454.CMB.1.raw
  modified_base (154)..(155): a, c, t, g, unknown or other
  misc_feature (154)..(155): n is a, c, g, or t
tcagcgatcgtatacacgaccggtgctcgatttagctctacgctcagggcacgaccggtgctcgatttagctgtgcgtcgaagggaaagggcagcgtcactctgttcccgccctcctctcgtagcactctgagcgggctggcaaggcgcatagnn

SEQ ID NO: 262473 - DNA, 152 bp, Homo sapiens; identical to SEQ ID NO: 262423
  misc_feature: GYAE6OF02FPPOG.51.73.G07.1.454.CMB.1.raw
  modified_base (152)..(152): a, c, t, g, unknown or other
  misc_feature (152)..(152): n is a, c, g, or t

SEQ ID NO: 262474 - DNA, 159 bp, Homo sapiens
  misc_feature: GYAE6OF02I2ZVO.51.73.G07.1.454.CMB.1.raw
  modified_base (154)..(159): a, c, t, g, unknown or other
  misc_feature (154)..(159): n is a, c, g, or t
tcagcgatcgtatacacgaccggtgctcgatttagctctacgctcagggcacgaccggtgctcgatttagagtgctaccgaagggaaagggcagcgtcactctgttcccaccctcctctcgtagcactctgagcgggctggcaaggcgcatagnnnnnn

SEQ ID NO: 262475 - DNA, 196 bp, Homo sapiens
  misc_feature: GYAE6OF02IBY31.51.73.G07.1.454.CMB.1.raw
  modified_base (194)..(196): a, c, t, g, unknown or other
  misc_feature (194)..(196): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnn

SEQ ID NO: 262476 - DNA, 292 bp, Homo sapiens
  misc_feature: GYAE6OF02IK1JQ.51.73.G07.1.454.CMB.1.raw
  modified_base (287)..(292): a, c, t, g, unknown or other
  misc_feature (287)..(292): n is a, c, g, or t
tcagcgatcgtatacacgaccggtgctcgatttagctctacgctcagggcacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggcactctgttcccgcatctgatccgtagcactctgagcgggctgggaccaaggcgcattagnnnnnn

SEQ ID NO: 262477 - DNA, 154 bp, Homo sapiens; identical to SEQ ID NO: 262231
  misc_feature: GYAE6OF02G2TH0.51.73.G07.1.454.CMB.1.raw
  modified_base (153)..(154): a, c, t, g, unknown or other
  misc_feature (153)..(154): n is a, c, g, or t

SEQ ID NO: 262478 - DNA, 524 bp, Homo sapiens
  misc_feature: GYAE6OF02IUDQA.51.73.G07.1.454.CMB.1.raw
  modified_base (238)..(238): a, c, t, g, unknown or other
  misc_feature (238)..(238): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaangccaccctctcctgcagggccagtgagagtattgacatcttcttggcctggtaccaacagaaacctggccaggcctccccgactcctcatttatgatgcatccaaaagggtcgttggcactcccagccaggttcagtgcagtggtctgggacagaattcactctcacatcaccagactagacgcctagaagtatttgctagtttattactgtcagcagtcgtaacactggcttctctttcgggcggtaggacctaaggtagagactacgaaacgtagtgtgctacg

SEQ ID NO: 262479 - DNA, 188 bp, Homo sapiens
  misc_feature: GYAE6OF02GXQDY.51.73.G07.1.454.CMB.1.raw
  modified_base (188)..(188): a, c, t, g, unknown or other
  misc_feature (188)..(188): n is a, c, g, or t
tcagcgatcgtatacacgaccggtgctcgatttagctctacgctcagggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagn

SEQ ID NO: 262480 - DNA, 151 bp, Homo sapiens
  misc_feature: GYAE6OF02HJP65.51.73.G07.1.454.CMB.1.raw
  modified_base (151)..(151): a, c, t, g, unknown or other
  misc_feature (151)..(151): n is a, c, g, or t
tcagcgatcgtatacacgaccggtgctcgatttagctctacgctcagggcacgaccggtgctcgatttagagtgctacgaagggaaagggcagcgtcactctgttcccgctcctctcgtagcactctgagcgggctggcaaggcgcatagn

SEQ ID NO: 262481 - DNA, 153 bp, Homo sapiens; identical to SEQ ID NO: 262233
  misc_feature: GYAE6OF02FKSU9.51.73.G07.1.454.CMB.1.raw
  modified_base (153)..(153): a, c, t, g, unknown or other
  misc_feature (153)..(153): n is a, c, g, or t

SEQ ID NO: 262482 - DNA, 132 bp, Homo sapiens
  misc_feature: GYAE6OF02JHSNE.51.73.G07.1.454.CMB.1.raw
  modified_base (130)..(132): a, c, t, g, unknown or other
  misc_feature (130)..(132): n is a, c, g, or t
tcagcgatcgtatacacgaccggtgctcgatttagctctacgctcagggcacgaccggtgctcgatttagctagtcactctgttcccacctcctctcgtagcactctgagcggctggcaaggcgcatagnnn

SEQ ID NO: 262483 - DNA, 185 bp, Homo sapiens
  misc_feature: GYAE6OF02I8F1R.51.73.G07.1.454.CMB.1.raw
  modified_base (156)..(185): a, c, t, g, unknown or other
  misc_feature (156)..(185): n is a, c, g, or t
tcagcgatcgtatacacgaccggtgctcgatttagctctacgctcgaggggcacgaccggtgctcgatttagctacgctctaagggaaagggcagcgtcactctgttcccaccctcctctcgtagcactctgagcgggctggcaaggcgcatacgnnnnnnnnnnnnnnnnnnnnnnnnnnnnnn

SEQ ID NO: 262484 - DNA, 155 bp, Homo sapiens; identical to SEQ ID NO: 262259
  misc_feature: GYAE6OF02FE6NT.51.73.G07.1.454.CMB.1.raw
  modified_base (153)..(155): a, c, t, g, unknown or other
  misc_feature (153)..(155): n is a, c, g, or t

SEQ ID NO: 262485 - DNA, 196 bp, Homo sapiens
  misc_feature: GYAE6OF02HP1HL.51.73.G07.1.454.CMB.1.raw
  modified_base (190)..(196): a, c, t, g, unknown or other
  misc_feature (190)..(196): n is a, c, g, or t
tcagcgatcgtatacacgaccggtgctcgatttagctctacgctcagggtcgacgaccggtgctcgatttacgctctacgctcagggcacgaccggtgctccgatttagagtgctacgaagggaaaggcagcgtcactctgttcccaccctcctctcgtagcactctgagcggctggcaaggcgcatagnnnnnnn

SEQ ID NO: 262486 - DNA, 152 bp, Homo sapiens
  misc_feature: GYAE6OF02FFAU7.51.73.G07.1.454.CMB.1.raw
  modified_base (145)..(145): a, c, t, g, unknown or other
  misc_feature (145)..(145): n is a, c, g, or t
  modified_base (151)..(152): a, c, t, g, unknown or other
  misc_feature (151)..(152): n is a, c, g, or t
tcagcgatcgtatacacgaccggtgctcgatttagctctacgctcagggcacgaccggtgctcgatttagagtgctacgaagggaagggcagcgtcactctgttcccatcctcctctcgtagcactcgagcgggctggcaaggcncatagnn

SEQ ID NO: 262487 - DNA, 153 bp, Homo sapiens; identical to SEQ ID NO: 262219
  misc_feature: GYAE6OF02GMO79.51.73.G07.1.454.CMB.1.raw
  modified_base (153)..(153): a, c, t, g, unknown or other
  misc_feature (153)..(153): n is a, c, g, or t

SEQ ID NO: 262488 - DNA, 197 bp, Homo sapiens
  misc_feature: GYAE6OF02GBN2P.51.73.G07.1.454.CMB.1.raw
  modified_base (192)..(197): a, c, t, g, unknown or other
  misc_feature (192)..(197): n is a, c, g, or t
tcagcgatcgtatacacgaccggtgctcgatttagctctacgctcagggcacgaccggtgctcgatttagagtgctacgaagggaaagggcacgaccggtgctcgatttagagtgctacgaagggaaaggcagcgtcactctgttcccaccctccctcgtagcactctgagcgggctggcaaggcgcatagnnnnnn

SEQ ID NO: 262489 - DNA, 291 bp, Homo sapiens
  misc_feature: GYAE6OF02IAJ6T.51.73.G07.1.454.CMB.1.raw
  modified_base (285)..(291): a, c, t, g, unknown or other
  misc_feature (285)..(291): n is a, c, g, or t
tcagcgatcgtatacacgaccggtgctcgatttagctctacgctcagggcacgaccggtgctcgatttagagctcacgtattgggggcaaagctgccctgaccctttcgggtggcgcagcctgaggatgaggctgagtattactgcttgctctcctatagtggtgttcgggtgttcggcggagggaccaagctgaccgtcctaggtcagcccaaggctcgcccctcggtcactctgttcccgcatctgatcgtagcactctgagcgggctggcaaggcgcatagnnnnnnn

SEQ ID NO: 262490 - DNA, 823 bp, Homo sapiens
  misc_feature: GYAE6OF02I5QSW.51.73.G07.1.454.CMB.1.raw
  modified_base (240)..(240): a, c, t, g, unknown or other
  misc_feature (240)..(240): n is a, c, g, or t
tcagcgatcgtatacacgaccggtgctcgatttagctctacgctcagggcacgaccggtgctcgatttagtacacgtgattaggggattggggggaggaactgctcagttaggacccagagggaaccatggaagccccagctcagcttctcttcctcctgctactctggctcccagataccatcggggaaactgtgttgacacagtctccagccaccctgtctttgtctccaggggaaanagccaccctctcctgcagggccagtgagagtatgacatcttcttggcctggtaccaacagaaacctggccaggcctccccgactccctcactttatcgatcgacataccgaaaacgggttcgttcggcaattccccgaagtcccgtagggtttaccaaggttcggacgtacgggtacggggtccgtagggggactaacggtaaacttttccggaacctttccgtaccgtaccctaacgttaccaaacccgtacgaaacccgttaaggaacgtacccgttaggtaaaccgtaagttttttaccggaccgttaaggtttttaactttaccgtttacggtaccgtaaggtccgtaacgtaaccggttaaaccgtaaaaccgttcgggtacccttttaccgtttacccggtttttaacccgggggtaccgggggttaaacccgggggttaaaaccgggtaaacccggggggttttaacgggggtaaacccgggttaaaccgggtttaaccccgggttaaaaaaaccccggggtaaacccggtttacgggggttttaacccggggtaacccggttttaaaccccgggg

SEQ ID NO: 262491 - DNA, 117 bp, Homo sapiens
  misc_feature: GYAE6OF02H2KAQ.51.73.G07.1.454.CMB.1.raw
tcagcgatcgtatacacgaccggtgctcgatttagctctacgctcagggcacgaccggtgctcgatttagagtgctacgaagggaaagggcagcgtcactctgttcccaccctcctc

SEQ ID NO: 262492 - DNA, 154 bp, Homo sapiens; identical to SEQ ID NO: 262264
  misc_feature: GYAE6OF02IY77A.51.73.G07.1.454.CMB.1.raw
  modified_base (153)..(154): a, c, t, g, unknown or other
  misc_feature (153)..(154): n is a, c, g, or t

SEQ ID NO: 262493 - DNA, 152 bp, Homo sapiens; identical to SEQ ID NO: 262246
  misc_feature: GYAE6OF02GIPSX.51.73.G07.1.454.CMB.1.raw

SEQ ID NO: 262494 - DNA, 155 bp, Homo sapiens; identical to SEQ ID NO: 262229
  misc_feature: GYAE6OF02HFUN1.51.73.G07.1.454.CMB.1.raw
  modified_base (153)..(155): a, c, t, g, unknown or other
  misc_feature (153)..(155): n is a, c, g, or t

SEQ ID NO: 262495 - DNA, 153 bp, Homo sapiens; identical to SEQ ID NO: 262233
  misc_feature: GYAE6OF02IKY57.51.73.G07.1.454.CMB.1.raw
  modified_base (153)..(153): a, c, t, g, unknown or other
  misc_feature (153)..(153): n is a, c, g, or t

SEQ ID NO: 262496 - DNA, 154 bp, Homo sapiens; identical to SEQ ID NO: 262231
  misc_feature: GYAE6OF02I5PMZ.51.73.G07.1.454.CMB.1.raw
  modified_base (153)..(154): a, c, t, g, unknown or other
  misc_feature (153)..(154): n is a, c, g, or t

SEQ ID NO: 262497 - DNA, 147 bp, Homo sapiens
  misc_feature: GYAE6OF02IDC3T.51.73.G07.1.454.CMB.1.raw
  modified_base (141)..(147): a, c, t, g, unknown or other
  misc_feature (141)..(147): n is a, c, g, or t
tcagcgatcgtatacacgaccggtgctcgatttagctctacgctcaggccacgaccggtgctcgatttatccacgcccagagctcgaaaacaccgcgccatctgatcgtagcactctgagcgggctggcaaggcgcatagnnnnnnn

SEQ ID NO: 262498 - DNA, 213 bp, Homo sapiens
  misc_feature: GYAE6OF02H2HR0.51.73.G07.1.454.CMB.1.raw
  modified_base (162)..(213): a, c, t, g, unknown or other
  misc_feature (162)..(213): n is a, c, g, or t
tcagcgatcgtatacacgaccggtgctcgatttagctctacgctcagggcgacgaccggtgctcgatttagacgtgctacgaagggaaagggcacgcgtcactctgttcccgccctcctctcgtagcactctgagcgggctcggccaaaggcgcaagttagnnnnnnnnnnnnnnnnnnnnnnnnnnnnnnnnnnnnnnnnnnnnnnnnnnnn

SEQ ID NO: 262499 - DNA, 291 bp, Homo sapiens
  misc_feature: GYAE6OF02JADT0.51.73.G07.1.454.CMB.1.raw
  modified_base (287)..(291): a, c, t, g, unknown or other
  misc_feature (287)..(291): n is a, c, g, or t
tcagcgatcgtatacacgaccggtgctcgatttagctctacgctcagggcacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctcgttcccgccatctgatcgtagcactctgagcgggctggcaaggcgcatagnnnnn

SEQ ID NO: 262500 - DNA, 155 bp, Homo sapiens; identical to SEQ ID NO: 262329
  misc_feature: GYAE6OF02FZY03.51.73.G07.1.454.CMB.1.raw
  modified_base (154)..(155): a, c, t, g, unknown or other
  misc_feature (154)..(155): n is a, c, g, or t

SEQ ID NO: 262501 - DNA, 156 bp, Homo sapiens
  misc_feature: GYAE6OF02FP4CQ.51.73.G07.1.454.CMB.1.raw
  modified_base (153)..(156): a, c, t, g, unknown or other
  misc_feature (153)..(156): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnn

SEQ ID NO: 262502 - DNA, 154 bp, Homo sapiens; identical to SEQ ID NO: 262231
  misc_feature: GYAE6OF02GMO8V.51.73.G07.1.454.CMB.1.raw
  modified_base (153)..(154): a, c, t, g, unknown or other
  misc_feature (153)..(154): n is a, c, g, or t

SEQ ID NO: 262503 - DNA, 141 bp, Homo sapiens; identical to SEQ ID NO: 262418
  misc_feature: GYAE6OF02IE9PQ.51.73.G07.1.454.CMB.1.raw
  modified_base (141)..(141): a, c, t, g, unknown or other
  misc_feature (141)..(141): n is a, c, g, or t

SEQ ID NO: 262504 - DNA, 177 bp, Homo sapiens
  misc_feature: GYAE6OF02HX5UT.51.73.G07.1.454.CMB.1.raw
  modified_base (155)..(177): a, c, t, g, unknown or other
  misc_feature (155)..(177): n is a, c, g, or t
tcagcgatcgtatacacgaccggtgctcgatttagctctacgctcaggggcgacgaccggtgctcgatttagagtgctacgaagggaaagggcagcgtcactctgttcccgccctcctctcgtagcactctgagcgggctggcaaggcgcatagnnnnnnnnnnnnnnnnnnnnnnn

SEQ ID NO: 262505 - DNA, 220 bp, Homo sapiens
  misc_feature: GYAE6OF02GD08I.51.73.G07.1.454.CMB.1.raw
  modified_base (198)..(220): a, c, t, g, unknown or other
  misc_feature (198)..(220): n is a, c, g, or t
tcagcgatcgtatacacgaccggtgctcgatttagctctacgctcagggcgacgaccggtgctcgatttagctctacgctcagggcacgaccggtgctcgatttagtcacgcgagaaagggaaggggctggccctgacgtgtttcctgttcccaccctcctctcgtagcactctgagcgggctggcaaggcgcatagnnnnnnnnnnnnnnnnnnnnnnn

SEQ ID NO: 262506 - DNA, 159 bp, Homo sapiens; identical to SEQ ID NO: 262424
  misc_feature: GYAE6OF02I0YKT.51.73.G07.1.454.CMB.1.raw
  modified_base (153)..(159): a, c, t, g, unknown or other
  misc_feature (153)..(159): n is a, c, g, or t

SEQ ID NO: 262507 - DNA, 162 bp, Homo sapiens
  misc_feature: GYAE6OF02JB4UE.51.73.G07.1.454.CMB.1.raw
  modified_base (153)..(162): a, c, t, g, unknown or other
  misc_feature (153)..(162): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnnnnnn

SEQ ID NO: 262508 - DNA, 289 bp, Homo sapiens
  misc_feature: GYAE6OF02H7AII.51.73.G07.1.454.CMB.1.raw
  modified_base (285)..(289): a, c, t, g, unknown or other
  misc_feature (285)..(289): n is a, c, g, or t
tcagcgatcgtatacacgaccggtgctcgatttagctctacgctcagggcacgaccggtgctcgatttagagctcacgtattggggggcaaagctgccctgaccctttcgggtgcgcagcctgaggatgaggctgagtattactgcttgctctctatagtggtgttcgggtgttcggcggagggaccaagctgaccgtcctaggtcagcccaaggctcgcccctggtcactctcgttcccgccatctgatcgtagcactctgagcgggctggcaaggcgcatagnnnnn

SEQ ID NO: 262509 - DNA, 153 bp, Homo sapiens; identical to SEQ ID NO: 262233
  misc_feature: GYAE6OF02JLI9K.51.73.G07.1.454.CMB.1.raw
  modified_base (153)..(153): a, c, t, g, unknown or other
  misc_feature (153)..(153): n is a, c, g, or t

SEQ ID NO: 262510 - DNA, 153 bp, Homo sapiens; identical to SEQ ID NO: 262219
  misc_feature: GYAE6OF02H7IKV.51.73.G07.1.454.CMB.1.raw
  modified_base (153)..(153): a, c, t, g, unknown or other
  misc_feature (153)..(153): n is a, c, g, or t

SEQ ID NO: 262511 - DNA, 156 bp, Homo sapiens
  misc_feature: GYAE6OF02F1GRR.51.73.G07.1.454.CMB.1.raw
  modified_base (153)..(156): a, c, t, g, unknown or other
  misc_feature (153)..(156): n is a, c, g, or t
tcagcgatcgtatacacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnnnn

SEQ ID NO: 262512 - DNA, 154 bp, Homo sapiens
  misc_feature: GYAE6OF02H924D.51.73.G07.1.454.CMB.1.raw
  modified_base (152)..(154): a, c, t, g, unknown or other
  misc_feature (152)..(154): n is a, c, g, or t
tcagcgatcgtatacacgaccggtgctcgatttagctctacgctcagggcacgaccggtgctcgatttagtcgatatgaagggaaagggcagcgtcactctgttcccaccctcctctcgtagcactctgagcgggctggcaaggcgcatagnnn

SEQ ID NO: 262513 - DNA, 141 bp, Homo sapiens
  misc_feature: GYAE6OF02F5861.51.73.G07.1.454.CMB.1.raw
  modified_base (138)..(138): a, c, t, g, unknown or other
  misc_feature (138)..(138): n is a, c, g, or t
  modified_base (140)..(141): a, c, t, g, unknown or other
  misc_feature (140)..(141): n is a, c, g, or t
tcagcgatcgtatacacgaccggtgctcgatttagctctacgctcagggcacgaccggtgctcgatttagctctacgctcagggcacgaccggtgctcgatttagtctagcgacttcgaggcggctgacgaggcacangnn

SEQ ID NO: 262514 - DNA, 152 bp, Homo sapiens; identical to SEQ ID NO: 262308
  misc_feature: GYAE6OF02IA773.51.73.G07.1.454.CMB.1.raw

SEQ ID NO: 262515 - DNA, 235 bp, Homo sapiens
  misc_feature: GYAE6OF02FO0KX.51.73.G07.1.454.CMB.1.raw
  modified_base (231)..(235): a, c, t, g, unknown or other
  misc_feature (231)..(235): n is a, c, g, or t
tcagcgatcgtatacacgaccggtgctcgatttagctctacgctcagggcacgaccggtgctcgatttagacagtatatatccgcgggcacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnnnnn

SEQ ID NO: 262516 - DNA, 185 bp, Homo sapiens
  misc_feature: GYAE6OF02HCK1P.51.73.G07.1.454.CMB.1.raw
  modified_base (154)..(185): a, c, t, g, unknown or other
  misc_feature (154)..(185): n is a, c, g, or t
tcagcgatcgtatacacgaccggtgctcgatttagctctacgctcagggcacgaccggtgctcgatttagctgtgcgtcgaagggaaagggcagcgtcactctgttcccacctcctctcgtagcactctggagcgggctggcaaggcgcatagnnnnnnnnnnnnnnnnnnnnnnnnnnnnnnnn

SEQ ID NO: 262517 - DNA, 182 bp, Homo sapiens
  misc_feature: GYAE6OF02IK273.51.73.G07.1.454.CMB.1.raw
  modified_base (156)..(159): a, c, t, g, unknown or other
  misc_feature (156)..(159): n is a, c, g, or t
  modified_base (161)..(182): a, c, t, g, unknown or other
  misc_feature (161)..(182): n is a, c, g, or t
tcagcgatcgtatacacgaccggtgctcgatttagctctacgctcgagggcacgaccggtgctcgatttagctacgctctaagggaaagggcagcgtcactctgttcccgcccttcctactcgtagcactctgagcgggctggcaaggcgcatagnnnntnnnnnnnnnnnnnnnnnnnnnn

SEQ ID NO: 262518 - DNA, 156 bp, Homo sapiens
  misc_feature: GYAE6OF02FPNMP.51.73.G07.1.454.CMB.1.raw
  modified_base (152)..(156): a, c, t, g, unknown or other
  misc_feature (152)..(156): n is a, c, g, or t
tcagcgatcgtatacacgaccggtgctcgatttagctctacgctcagggcacgaccggtgctcgatttagaggctacgaagggaaagggcagcgtcactctgttcccgccctcctctcgtagcactctgagcgggctggcaaggcgcatagnnnnn

SEQ ID NO: 262519 - DNA, 155 bp, Homo sapiens; identical to SEQ ID NO: 262229
  misc_feature: GYAE6OF02FGJYI.51.73.G07.1.454.CMB.1.raw
  modified_base (153)..(155): a, c, t, g, unknown or other
  misc_feature (153)..(155): n is a, c, g, or t

SEQ ID NO: 262520 - DNA, 158 bp, Homo sapiens
  misc_feature: GYAE6OF02F9VHW.51.73.G07.1.454.CMB.1.raw
  modified_base (153)..(158): a, c, t, g, unknown or other
  misc_feature (153)..(158): n is a, c, g, or t
tcagcgatcgtatacacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnnnnn

SEQ ID NO: 262521 - DNA, 158 bp, Homo sapiens
  misc_feature: GYAE6OF02I2VVP.51.73.G07.1.454.CMB.1.raw
  modified_base (143)..(158): a, c, t, g, unknown or other
  misc_feature (143)..(158): n is a, c, g, or t
tcagcgatcgtatacacgaccggtgctcgatttagctctacgctcagggcacgaccggtgctcgatttagctctacgctcagggcacgaccggtgctcgatttagtctagcgacttcaggcggctggacgaaggcgcagtagnnnnnnnnnnnnnnnn

SEQ ID NO: 262522 - DNA, 153 bp, Homo sapiens
  misc_feature: GYAE6OF02IL9V4.51.73.G07.1.454.CMB.1.raw
  modified_base (149)..(153): a, c, t, g, unknown or other
  misc_feature (149)..(153): n is a, c, g, or t
tcagcgatcgtatacacgaccggtgctcgatttagctctacgctcagggcacgaccggtgctcgattagagtgctacgaagggaaagggcagcgtcactctgttcccacctctctcgtagcactctgagcggctggcaaggcgcatagnnnnn

SEQ ID NO: 262523 - DNA, 153 bp, Homo sapiens; identical to SEQ ID NO: 262233
  misc_feature: GYAE6OF02F4IRJ.51.73.G07.1.454.CMB.1.raw
  modified_base (153)..(153): a, c, t, g, unknown or other
  misc_feature (153)..(153): n is a, c, g, or t

SEQ ID NO: 262524 - DNA, 180 bp, Homo sapiens
  misc_feature: GYAE6OF02F03VD.51.73.G07.1.454.CMB.1.raw
  modified_base (156)..(180): a, c, t, g, unknown or other
  misc_feature (156)..(180): n is a, c, g, or t
tcagcgatcgtatacacgaccggtgctcgatttagctctacgctcgaggggcacgaccggtgctcgatttagagtgctacggggaaagggcagcgtcacctctgttcccaccctcctctcgtagcactctgagcgggctgggcaaggcgctatagnnnnnnnnnnnnnnnnnnnnnnnnn

SEQ ID NO: 262525 - DNA, 155 bp, Homo sapiens; identical to SEQ ID NO: 262229
  misc_feature: GYAE6OF02FW7XF.51.73.G07.1.454.CMB.1.raw
  modified_base (153)..(155): a, c, t, g, unknown or other
  misc_feature (153)..(155): n is a, c, g, or t

SEQ ID NO: 262526 - DNA, 566 bp, Homo sapiens
  misc_feature: GYAE6OF02GU0JS.51.73.G07.1.454.CMB.1.raw
  modified_base (356)..(356): a, c, t, g, unknown or other
  misc_feature (356)..(356): n is a, c, g, or t
tcagcgatcgtatacacgaccggtgctcgatttagctctacgctcaggggcacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaagagccaccctctcctgcagggtccagtgagagtatgacatcttcttggcctggtaccaacagaacctggccaggcctccccgactcctctattatgatgcatccaaaggtcgtggacancccagccaggtcagtgacagtggtctgggacagagttcacgtctacaccatcacagacctagacgccgtagaagtatttacgctagttttactacgttcgtctagacgtagtaccgtaaacaacgttcggcttaccgttcggttacggtcgggaacgggacaacgggttaggacgtacgtacgaaaccgagttcggtacggcgtaaccgg

SEQ ID NO: 262527 - DNA, 154 bp, Homo sapiens; identical to SEQ ID NO: 262264
  misc_feature: GYAE6OF02IVCGR.51.73.G07.1.454.CMB.1.raw
  modified_base (153)..(154): a, c, t, g, unknown or other
  misc_feature (153)..(154): n is a, c, g, or t

SEQ ID NO: 262528 - DNA, 235 bp, Homo sapiens
  misc_feature: GYAE6OF02FKHYJ.51.73.G07.1.454.CMB.1.raw
  modified_base (228)..(235): a, c, t, g, unknown or other
  misc_feature (228)..(235): n is a, c, g, or t
tcagcgatcgtatacacgaccggtgctcgatttagctctacgctcagggcacgaccggtgctcgatttagctctacgctcagggcacgaccggtgctcgatttagaggtgctacgaagggaaagggcacgaccggtgctcgatttagagtgctacgaagggaaagggcagcgtcactctgttcccaccctctctcgtagcactctgagcggctggcaaggcgcatagnnnnnnnn

SEQ ID NO: 262529 - DNA, 157 bp, Homo sapiens
  misc_feature: GYAE6OF02H3YV7.51.73.G07.1.454.CMB.1.raw
  modified_base (154)..(157): a, c, t, g, unknown or other
  misc_feature (154)..(157): n is a, c, g, or t
tcagcgatcgtatacacgaccggtgctcgatttagctctacgctcagggcacgaccggtgctcgatttagctgtgcgtcgaagggaaagggcagcgtcactctgttcccgccctcctctcgtagcactctgagcgggctggcaaggcgcatagnnnn

SEQ ID NO: 262530 - DNA, 189 bp, Homo sapiens
  misc_feature: GYAE6OF02FZLE3.51.73.G07.1.454.CMB.1.raw
  modified_base (184)..(189): a, c, t, g, unknown or other
  misc_feature (184)..(189): n is a, c, g, or t
tcagcgatcgtatacacgaccggtgctcgatttagctctacgctcagggccggtgctcgatttagctctacgctcagggcacgaccggtgctcgatttagtcacgcgagaaagggaaagggcagcgtcactctgttcccaccctcctctcgtagcactctgagcgggctggcaaggcgcatagnnnnnn

SEQ ID NO: 262531 - DNA, 390 bp, Homo sapiens
  misc_feature: GYAE6OF02F5N3D.51.73.G07.1.454.CMB.1.raw
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (313)..(318): a, c, t, g, unknown or other
  misc_feature (313)..(318): n is a, c, g, or t
  modified_base (320)..(321): a, c, t, g, unknown or other
  misc_feature (320)..(321): n is a, c, g, or t
  modified_base (324)..(324): a, c, t, g, unknown or other
  misc_feature (324)..(324): n is a, c, g, or t
  modified_base (327)..(390): a, c, t, g, unknown or other
  misc_feature (327)..(390): n is a, c, g, or t
tcagcgatcgtatacacgaccggtgctcgatttagctctacgctcagggcacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctggtcactctcgttcccgcatctgatcgtagctactctggacgccggggactcgggactaaagggccacaagttaggntnacngtncnnnnnntnncanctnnnnnnnnnnnnnnnnnnnnnnnnnnnnnnnnnnnnnnnnnnnnnnnnnnnnnnnnnnnnnnnn

SEQ ID NO: 262532 - DNA, 771 bp, Homo sapiens
  misc_feature: GYAE6OF02JS0YJ.51.73.G07.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (630)..(630): a, c, t, g, unknown or other
  misc_feature (630)..(630): n is a, c, g, or t
  modified_base (653)..(653): a, c, t, g, unknown or other
  misc_feature (653)..(653): n is a, c, g, or t
  modified_base (731)..(731): a, c, t, g, unknown or other
  misc_feature (731)..(731): n is a, c, g, or t
tcagcgatcgtatacacgaccggtgctcgatttagctctacgctcagggcacgaccggtgctcgattttagtacacgtgattagggattggggggaggaactgctcagttaggacccagagggaaccatggaagccccagctcagcttctcttcctcctgctactctgctcccagactaccagtcggggaaactgtgtagacacagtcnccagccaccctgtctttgctccggaaggggaaacncgtcccacccgtctccgtcggaccgacgggccctaggtaggacgtaagttaacgttacggaaccttatttccgtttccgtttcgggtacccgtttaccgggtaaacccaaaccgtaaaccggtaaaaccccgttcggggaccccgtaaccggggtccccccttacccccggtacccttccccttaagttacttttaacgtcgtaacgtcgtaccgtaactaaccggtaaagggttccgttagggaccctacgaccccaggtacccgtaggttaccgaggttcgggcgtaagggtcggggttaccgtaggggaactaacggtaacttccgtaacgtccctaccgaacacgtaccaccgagtaaccaggactaccgtaaggtacgttntttcgaacttaagtttattacgngtacgtagtacgtaacgacgttaaacctagttccgtacttccgttacgggttacggccgggtaagtacgaacgggtanacggtaacgttaacgaacggtacgtggtacgtctaaccgg

SEQ ID NO: 262533 - DNA, 725 bp, Homo sapiens
  misc_feature: GYAE6OF02G1T4R.51.73.G07.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
tcagcgatcgtatacacgaccggtgctcgatttagctctacgctcagggcacgaccggtgctcgatttagtacacgtgattagggattgggggaggaactgctcagttaggacccagagggaaccatggaagccccagctcagcttctcttcctcctgctactctggctcccagactaccatcggggaaactgtgtgacacagtctccagccctaccctgttcttgtcctaccgaagggaaancgcctaccctctcctgcnggccagngagacgtatgactattcgttcgttcggtccgttacgtaacctaaacgaacgtaaacccgtcgggacctacggcccctaccccgtacctcccgtactacgttttactacgtactcgaccttaactaaaccgggtaaaagggttccggttacgggtacctaccgtacccgtaccggaccgtacggttaccgaggtacggacggtacgggttggggtccggtagggtaacgtaaggtaaacctttaccgacctttcgaccctaaacccacgtaccgtaaccctaacgtaaccgttaacggaccgtacgtacggttaaattacgtttacgtacgtttacgtttaagttaccgtagtacgtacgtacgaacgtaaccgtaactaacgttcgtcctcgtacgttcgggacgggtaacgtacggtacgtaggacgtaagtacaacggtactggtcgtacgtacg

SEQ ID NO: 262534 - DNA, 248 bp, Homo sapiens
  misc_feature: GYAE6OF02GW5O1.51.73.G07.1.454.CMB.1.raw
  modified_base (227)..(227): a, c, t, g, unknown or other
  misc_feature (227)..(227): n is a, c, g, or t
  modified_base (232)..(248): a, c, t, g, unknown or other
  misc_feature (232)..(248): n is a, c, g, or t
tcagcgatcgtatacacgaccggtgctcgatttagctctacgctcagggcacgaccggtgctcgatttagacagtatatatccgcgggcacgaccggtgctcgatttagacagtatatatccgcgggcacgaccggtgctcgatttagagtgctacgaagggaaagggcagcgtcactctgttcccgccctcctctctagcactctgagcgggctggccaaggccgnatagnnnnnnnnnnnnnnnnn

SEQ ID NO: 262535 - DNA, 177 bp, Homo sapiens
  misc_feature: GYAE6OF02IY6XN.51.73.G07.1.454.CMB.1.raw
  modified_base (150)..(177): a, c, t, g, unknown or other
  misc_feature (150)..(177): n is a, c, g, or t
tcagcgatcgtatacacgaccggtgctcgatttagctctacgctcagggcacgaccggtgctcgatttagagtgctacgaagggaaagggcagcgtcactctcccgccctcctctcgtagcactctgagcgggctggcaaggcgcaatgnnnnnnnnnnnnnnnnnnnnnnnnnnnn

SEQ ID NO: 262536 - DNA, 334 bp, Homo sapiens
  misc_feature: GYAE6OF02FWISR.51.73.G07.1.454.CMB.1.raw
  modified_base (246)..(247): a, c, t, g, unknown or other
  misc_feature (246)..(247): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
  modified_base (268)..(334): a, c, t, g, unknown or other
  misc_feature (268)..(334): n is a, c, g, or t
tcagcgatcgtatacacgaccggtgctcgatttagctctacgctcagggcacgaccggtgctcgatttagcgagacgcgcagggcacgaccggtgctcgatttagtcacgcgagaaagggaaggcacgaccggtgctcgatttagaatgctaacgaagggaacgggcaggcgtcactctgttccccgccctctcgtcgtagcacttctgaggccgggctggacaaggccgacagtagcagctacgnncntncctncatgncnntgnannnnnnnnnnnnnnnnnnnnnnnnnnnnnnnnnnnnnnnnnnnnnnnnnnnnnnnnnnnnnnnnnnn

SEQ ID NO: 262537 - DNA, 156 bp, Homo sapiens
  misc_feature: GYAE6OF02GGJ9P.51.73.G07.1.454.CMB.1.raw
  modified_base (154)..(156): a, c, t, g, unknown or other
  misc_feature (154)..(156): n is a, c, g, or t
tcagcgatcgtatacacgaccggtgctcgatttagctctacgctcagggcacgaccggtgctcgatttagagtgctacgaagggaaagggcagcgtcactctgttccccgccctcctctcgtagcactctgagcgggctggcaaggcgcatagnnn

SEQ ID NO: 262538 - DNA, 164 bp, Homo sapiens
  misc_feature: GYAE6OF02GKTNW.51.73.G07.1.454.CMB.1.raw
  modified_base (152)..(164): a, c, t, g, unknown or other
  misc_feature (152)..(164): n is a, c, g, or t
tcagcgatcgtatacacgaccggtgctcgatttagctctacgctcagggcacgaccggtgctcgatttagagtgctacgaagggaaagggcagcgtcactctgttcccacctcctctcgtagcactctgagcgggctggcaaggcgcatagnnnnnnnnnnnnn

SEQ ID NO: 262539 - DNA, 190 bp, Homo sapiens
  misc_feature: GYAE6OF02JISZ8.51.73.G07.1.454.CMB.1.raw
  modified_base (164)..(190): a, c, t, g, unknown or other
  misc_feature (164)..(190): n is a, c, g, or t
tcagcgatcgtatacacgaccggtgctcgatttagctctacgctcagggcacgaccggtgctcgatttagtcacgcgagaaagggaagggggctggccctgacgtgttctgttcccgcctcctctcgtagcactctgacgcgggctgggacaaggcgcatagcnnnnnnnnnnnnnnnnnnnnnnnnnnn

SEQ ID NO: 262540 - DNA, 480 bp, Homo sapiens
  misc_feature: GYAE6OF01BLYR3.35.53.E09.1.454.CMB.1.raw
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagtacagatcgtcacgaccggtgctcgatttagagagagtgtgttgggtttggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccggcaagtcagaccgttcgcgtctatttaaattggtatcagcagaaaccaggaacgcccctcagctgctgctctatactgtatctagtttccatcttgggtccatcaaggttcagtgcagtggtctgggacagatttcactctcactatcagcagtctgcaacctgaagatgttgctaacttactactgtcaacagtacttacacggcccattccactttcgcctggaccacagtcaatccagcgaactgtcgctgcnccntcg

SEQ ID NO: 262541 - DNA, 487 bp, Homo sapiens
  misc_feature: GYAE6OF01BUH32.35.53.E09.1.454.CMB.1.raw
  modified_base (392)..(392): a, c, t, g, unknown or other
  misc_feature (392)..(392): n is a, c, g, or t
  modified_base (483)..(483): a, c, t, g, unknown or other
  misc_feature (483)..(483): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtcccatcaaggttcagtggcagtggttctgggacagatttcactctcactatcagcagtctgcaacctgaagntgttgcaacttactactgtcaacagacttacacggcccattcacttcggccctgggaccacagtcgaaatccagcgaactgtcgctgcacntccg

SEQ ID NO: 262542 - DNA, 500 bp, Homo sapiens
  misc_feature: GYAE6OF01CQE2H.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttggggtcccatcaaggttcagtggcagtggtctgggacagatttcactctcactatcagcagtctgcaacctgaagtattttgacctaaccttactattgtacaactagaagttacagtacgccgcgatcagctcggaccaagggacgacgactggagaagttaaaagactagtgatgcactacg

SEQ ID NO: 262543 - DNA, 521 bp, Homo sapiens
  misc_feature: GYAE6OF01CUJC4.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtattcagacagaaaaccagggaaacgcccctcagctgctgctctatactgtatctagtttccatcttgggtcccatcaagttcagtggcagttgtctggcagattcactctcactatcagcagtctgaccaaacctgtaagattgtgactaactttactactgtacaacaagtacttacgaggacccctattccactttccggcccttcgggaccacgacgtacgtaaataccagaccgtaaactggtcggactgaccacgtacttcg

SEQ ID NO: 262544 - DNA, 517 bp, Homo sapiens
  misc_feature: GYAE6OF01API2K.35.53.E09.1.454.CMB.1.raw
  modified_base (511)..(511): a, c, t, g, unknown or other
  misc_feature (511)..(511): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccaggaacgcccctcagctgctgctctatactgtatctagtttccattcttggggtccctatcaaggttcagtggcaggtggttctgggactaggtatttcacttctctactactcagcagtctgctaacctgaagtattgttgactaacttactactcgtacaacagtacttacacgggtcccattcactttcggccctgggaccacgagtacgaatccagacgaactcggtcgactgccaccgnttaccg

SEQ ID NO: 262545 - DNA, 628 bp, Homo sapiens
  misc_feature: GYAE6OF01EDR3D.35.53.E09.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctgtcgganacagactgaccatcacttgccgggnaagtcagaccgttcgcgttctatttaaatggtatcagcaagaaaccgagggaaccncccctnacgctgctgctctatactgtatctagtttccattcgtcgggtccagtactaaggttcaggtcggactaggttcggttcgtggggactaggtacttttccgacttcctactaacttacttcacgtcaagttcctacgtaccaaccgtagaagtattgttcgaactaacttactactgtacaactacgtaaccttacgaaccgggtcccctaatttacccgtaccgtttacccggacccgttacgggacccctaaacgtaccggtaaccgtaaactacccgaacggtacccggtaaaccgttgggtaccgggtctaaccgcccgtaaacccgttgtttaccccgg

SEQ ID NO: 262546 - DNA, 549 bp, Homo sapiens
  misc_feature: GYAE6OF01EPN5H.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaaccgcccctcagctgctgctctatactgtatctagtttccatcttgggtcccatcaagttcagtgctagtggttctgggtacagtatttcacttctactactatcagcagtctgacctaacctagaagtatgttcgtactaacttactactagtacaactagaccttacgacgggtcccctaattcctaccgtttccggccccgttacgggaccctaacgtacggtaccgtaaactccgaacgaccgtaacgtcgtcggctaggacctacgcttccg

SEQ ID NO: 262547 - DNA, 612 bp, Homo sapiens
  misc_feature: GYAE6OF01ELUVQ.35.53.E09.1.454.CMB.1.raw
  modified_base (399)..(399): a, c, t, g, unknown or other
  misc_feature (399)..(399): n is a, c, g, or t
tcagtacagatcgtcacgaccggtgctcgatttagagagagtgtgttgggtttgggggagtcagtctcagtcaggacacagcatggacatgaggctccccgctcagctcctgggctcctgctactctggctccgaggtgccagatgtgacatccagatgacccagtctccggcctccctgtctggtgctgtcggagacagactgaccatcacttgccgggcaagtcagaccgttcgcgtctatttaattggtatcagcaagaaaccgaggaaccgcccctagacgctgctcgtctcttatactgtaattcttacgtttcacgttcgttcgggtccagtctagtcagtgctagtggtctggactagtacttcacttctctacttactacagcgtattcgngtaacctaacctgaacgtagttcgttactacgttaaccttacgttacctgtaacaactacgtaacccttacggaccggtaccccttaagttcccttaccgtttacccggccccggttacgacccgtaaccggtaacgttaccggtaaacctaccgacggaccgttaaacgtcgggttacgtaccgttaacggccccttaacgtaccgtttccg

SEQ ID NO: 262548 - DNA, 521 bp, Homo sapiens
  misc_feature: GYAE6OF01EAXIP.35.53.E09.1.454.CMB.1.raw
  modified_base (275)..(275): a, c, t, g, unknown or other
  misc_feature (275)..(275): n is a, c, g, or t
  modified_base (493)..(493): a, c, t, g, unknown or other
  misc_feature (493)..(493): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacncccctcagctgctgctctatactgtatcttagtttccattcttggggtcccatcaaggttcagtggctaggtggttcgtgggacagtatttcacttctacactatcagcagttctgcaacctgaagtatgttgactaacttacttactgtacaacagtactacgacgggtcccctattcctactttccggcccgtggaccacgacgtacgaataccgngacgaactcgtcggctgccncgnttccg

SEQ ID NO: 262549 - DNA, 568 bp, Homo sapiens
  misc_feature: GYAE6OF01D4RMM.35.53.E09.1.454.CMB.1.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctcctgtctggtgctggtcggagacagactgaccatcacttgccgggnaagtcagaccgttcgcgtctatttaaattggtatcagcagaaaccgaggaaccncccctcacgctcgctgctctatactgtatctattctattcgttcgggtccagtcaagttcagtggcgtagtggttcgtgggacagtatttcacttctactactatcagctagtctgacctaactagaagtattgttcgtactaactttactacttacgtacaaacgacgtaaccttacgaccggtacccctatttacccacgtttcccggtcccgtacgggacccacgtaacgtaccgtaaactcccgaacgaccgtaacgtcggtcgtaccgtacgacctaccgtgttccg

SEQ ID NO: 262550 - DNA, 621 bp, Homo sapiens
  misc_feature: GYAE6OF01CYDFK.35.53.E09.1.454.CMB.1.raw
  modified_base (189)..(189): a, c, t, g, unknown or other
  misc_feature (189)..(189): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctcccggcctccctgtctggtnctgtcggagacagactgaccatcacttggccgggcaagtcagtccgttcgcgtcttatttaaattggtatcagacaagaaaccgaagggaaccgcccctcacgctcgctcgctctaatacttgtattcttacgtttcctattccgtttcggggtcccacgttacgtaaggttcaaggtggtcgtaggttggttcgtagggactagtatttcactctcactatcacgtcacgttctcgacctaaccgtagaagtagttacgttacgacttaaccgtttaactacgttacgtactaaactaacgtaaccttaaccgaccggtaccccttaacgtttccctaccgtttccggtacccgttaccggaacctacgtacgtaaccgtaaactccggaacgaccgtaacgtcggtcggactcggaccaccgtcttaccg

SEQ ID NO: 262551 - DNA, 684 bp, Homo sapiens
  misc_feature: GYAE6OF01D9QN3.35.53.E09.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctccggcctcctgtctggtgctggtcgganacagactgaccatcacttggccggganaagtcagtacctttcgcgttacttaatttaaagttggtatcagacaacgaaccgacggaccgcccctcacgctgctcgctactactacttgtacttcttacgtttcctagttccgttcgggtaccctagtacgtaacggttcgaggtcggacgtcggttggttcgtagggtactacgttactttactaccgttcctacgtaacttacgttacgacgtacgtacgttcgtacgaacctaaaccgtagaacgtagttcggttacgtaaccttaaactttacctaacgttacgtaacctaacgtaacgtaacccgttaaccggaacccgggttacccttaacgttaccgttaccggtttccgacccggttaccggaacccgtaacgtaaccggtaccgtaaacgtaccgtaacggtaccgtaaacgttcggtacgtacgtacgacctaaccgtcgttaccg

SEQ ID NO: 262552 - DNA, 566 bp, Homo sapiens
  misc_feature: GYAE6OF01B4Q8U.35.53.E09.1.454.CMB.1.raw
  modified_base (408)..(408): a, c, t, g, unknown or other
  misc_feature (408)..(408): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtctccggcctccctgtctggtgcgtgtcggagacagactgaccatcacgttgccgggacaagtcgacgtaccgttcgcgtcttatttaatggtatcgcagaggccaggacgaacgccctaactactgatgtatactgtatctattgctatagtcgcgtaccatacaagtcagtgactaggtgatcgtaggactagtatttcgactctcactatcaaactatatacaactagaactacttanactaacttactactgacaactagtacttaacgaccggtaccctacgttaccttacgtttacccggacccgtacggtaacccacgtaccgtacctaacgtacctaacccgaaacgtaacttcggaggtacccgtagaccaacctcttcgtcggttaccc

SEQ ID NO: 262553 - DNA, 597 bp, Homo sapiens
  misc_feature: GYAE6OF01COJBD.35.53.E09.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggnaagtcagaccgttcgcgtcttaatttaaattggtatcagcaagaaaccagggaacgcccctnagctgctgctctatactgtatcttagtttccattcgttggggtcccgctaaggttcaggtggcagtggatcgtgggacagaattcactctacaccatcagcagtctagacctaaaccgtgtaagtattttcgacctaaccttacttattacgtacaacgtaagtaacgttactaacggttaccgcccgtacgaactccgtacggtccgttaccggacccgtaaagggaccgtaaccggacgttacgggaaacgttaaaacgttaaaaacggtacgttacgggttacgggaccgttacggacctaccgttaacg

SEQ ID NO: 262554 - DNA, 499 bp, Homo sapiens
  misc_feature: GYAE6OF01AVBUJ.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctattaaattggtatcagcagaaaccagggaacgcccctcagctgctgctctatactgtatctagtttccatctgggtccatcaaggttcagtggcagtggttctgggacaggatttcgactctcactatcagcagtctgcaacctgaagatgttcgctaacttactactgtcaacagacttacaggccctaattccactttcggaccctgggaccacgtacgtcgaaatccagacgaatcgtggctgctaccattccg

SEQ ID NO: 262555 - DNA, 662 bp, Homo sapiens
  misc_feature: GYAE6OF01C25ZM.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctggtcggagacagactgaccatcacgttcggccgggacaagtcacggtaccgttcgacgttacttaatttaaagttggtatcgagaccaacgaaaccgacgggaacccgccctacgacgtctcggcctgccttactactacgttgtacttcctttagtttcctagtttccggttcgggtccctagttaccgtaaggtttcagggttggcgtaggttcgggttcgttaggggaactagttaactttccgacgttctacacttatacagtactagttcgtacgaaccgtaacgtaagtaacgtagttacgttacgaaccttaacttacttatacgtaaccaaagtacgttaaccgtaccgtaccggtaccccttagtttacccgtacgttacccgggccgttacggaccctagaacgttaccgaacttacgacggtaaccgtagtcgtcggtacctagacctacgtacgttccg

SEQ ID NO: 262556 - DNA, 581 bp, Homo sapiens
  misc_feature: GYAE6OF01A9U00.35.53.E09.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggnaagtcgaagaccgttcgcgtacttaatttaaatggtatcagcaagaaccgaggaaccncccctnagctgctgctactatactgtaacttcttagtttcctagttccgttgggtacccagtacgtaaggttcaggtggctaggttgttcgtagggactagttacgtttcaacttctacaatatacgagtcagtctagactacgtagaacgtagttgtactactaactttacgtactactaacaactacgtaacctacgaccggtcccttattccgttaccgtccggtccgtaccggactacgtaacgtaccgtaatccgtaagaccgtaaagtcggtacgacttacgacctagtcttacg

SEQ ID NO: 262557 - DNA, 544 bp, Homo sapiens
  misc_feature: GYAE6OF01CVEMT.35.53.E09.1.454.CMB.1.raw
  modified_base (188)..(188): a, c, t, g, unknown or other
  misc_feature (188)..(188): n is a, c, g, or t
tcagtacagatcgtcacgaccggtgctcgatttagagagagtgtggttgggtttggggagtcagtctcagtcaggacacagcatggacatgaggctcccgctcagctcctggggctcctgctactctggctccgaggtgccaggatgtgacatccagatgacccagtctccggcctccctgtctggtnctgtccggagacagactgaccatcacttgccggcaagtcagaccgttcgacgtactatttaaattggtatcagtcaagaaaccagggaaccgccctcagctgctgctcaatactgtatctagtttccatcgttggggtccctaatctaaaggttcaggtgtcagttggtctgggactagtagtttcactctcactatcagctagtctagctaaaccgtgaacgacttgttacgaccttaacttacgtactacgtacaaactagtacttaacgacggtccctattaccgctttccgccgtggtaccacgtacgtaccgaactccaacgctaactggtacgcgttgactcaagttccg

SEQ ID NO: 262558 - DNA, 769 bp, Homo sapiens
  misc_feature: GYAE6OF01D9HQX.35.53.E09.1.454.CMB.1.raw
  modified_base (167)..(167): a, c, t, g, unknown or other
  misc_feature (167)..(167): n is a, c, g, or t
  modified_base (763)..(763): a, c, t, g, unknown or other
  misc_feature (763)..(763): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccgaggtgccagatgtgacatccagatcgacccngtcctccggcctccctgtctggtcgcgtggtcggagacagactgaacctatcctacgttcggacccgggtacaacggtccacggtaccccgttcgtaccgtttacttaaagttttaaagttggtactacgacgtaccgaaacgaaaaccggacgggaacccgtccccctacgacgtcgtcgcgtcgtccttacgttaattacgttacgttacttaccgtttacgtttacctacgtttccggtttaccggggttacccctaagttaaccgttaaacgggttcgtaacggttcgggtacgttagggttcgggtttacggtaggggtacctaggtttaacttaccgtaccttacctcctaacgttactaccgacgtacgtaccgttcgaccgtaaccctaacggttagaaggttacttcggttaactaaccgttaacctttacgtaaccgtttcgaaactaacgtaaccgtaccgtaaccgtacccggttacccttactttaccgtaccggtttcccggacccgtaaccggacctaacgtacggtaaccgtaaactcccgtaaggacccgttaagtcggtacgcgtacgcctaaccgtnttcccg

SEQ ID NO: 262559 - DNA, 616 bp, Homo sapiens
  misc_feature: GYAE6OF01BWIKV.35.53.E09.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctgtcggagacagactgaccatcactgccggnaagtcagccgttcgcgtctatttaattggtatcagcaagaaaccgaggaaccncccctnacgctgctcgctctatactgtactctacgtttctacgtcgttcgggtcccagtacgtaagttcgaggtggtacgtaggttcggttcgtagggtactagtacgtttacacttccgtactactatccgagtacgtacgtctacgacctaaccgtagaatacgttacgttctaaccttaactttactaacttacgtaaccgtaaagtaaccgttaacttaaccggaccggtacccctaacgtttaccctaccgtttcccggacccgtacggaccctaacgtacgtaaccgaatacccgagtaccgtacgtacggtcgacgtacgacctacgtcgttccg

SEQ ID NO: 262560 - DNA, 675 bp, Homo sapiens
  misc_feature: GYAE6OF01CTGSC.35.53.E09.1.454.CMB.1.raw
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
tcagtacagatcgtcacgaccggtgctcgatttagagagagtgtgttgggtttgggggagtcagtctcagtcaggacacagcatggacatgaggctccccgctcagctcctgggggctcctgctactctggctccgaggtgccagatgtgacatccagatgacccagtctccggcctccctgtctggtnctgtcgganacagactgaccatcacttcgccgggcaagtcagccgttcgcgtacttatttaaattggtatacagacaagaaaccgagggaaccgcccctacacgctcgctgctctaactactgtacttcttacgtttccagttccgttcggggtaccctatacgtaaggtttcgagttggcctaggttcggttcgtagggactagtactttcgactctacaacttactcacgtctacgttcctagtacctaaaccgtgtaacggtagttcgtttacgaccgttaaaccttttactacgttacgtacctaaaccgtacgtaaaccgtttaacccgaaccgggttaccccttaactttacccgttaccgtttacccgggtcccgttaaccggggaaaccctaaaggttaacccggtaaacgttaacccgacggtaccgtaaaccggttcggtaccggtccgtacgacaacccctagttcccgtttacg

SEQ ID NO: 262561 - DNA, 601 bp, Homo sapiens
  misc_feature: GYAE6OF01BK4FB.35.53.E09.1.454.CMB.1.raw
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (296)..(296): a, c, t, g, unknown or other
  misc_feature (296)..(296): n is a, c, g, or t
  modified_base (422)..(422): a, c, t, g, unknown or other
  misc_feature (422)..(422): n is a, c, g, or t
  modified_base (594)..(594): a, c, t, g, unknown or other
  misc_feature (594)..(594): n is a, c, g, or t
tcagtacagatcgtcacgaccggtgctcgatttagagagagtgtggttggggtttgggggagtcagtctcagtcaggacacagcatggacatgaggctccccgctcagctcctgggctcctgctactctggctccgaggtgccagatgtgacatccagatcgaacccngtcctccggcctccctgtctggtcgctggtcggagacagactgaccatcacttggccggganaagtcgagtaccgttcgcgtacttaatttaagttggtatctagaccaaggaaaccgacgggaaccncccctacacgtctcgctcgcttactatacgtgtacttcgttacgtttcacttcgttcggggtccagtcgtaaggttcaggtcggctaggttgttcgtgggtactagtacttcacgttctactactntacagtctaagtctacgtctaaacgtagtaagtcttagtacgtactaactttactactagtacaacgtagtaccgtacgtaccggtaccctattaccgtacttaccggccgttacggacctacgacgtaccgtaactaccgacgacgtaacgtcgtacggcacgcctacgtnttacccg

SEQ ID NO: 262562 - DNA, 563 bp, Homo sapiens
  misc_feature: GYAE6OF01DTMO8.35.53.E09.1.454.CMB.1.raw
  modified_base (275)..(275): a, c, t, g, unknown or other
  misc_feature (275)..(275): n is a, c, g, or t
  modified_base (438)..(438): a, c, t, g, unknown or other
  misc_feature (438)..(438): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagtaccgttgcgtctatttaaattggtatcagcagaaaccagggaacncccctcagctgctgctctatactgtatcttagtttccattcttcgggtccatctaaaggttcagtcggacaggttggttcgtgggacagtatttcgactctcactatcagcagtctagcaactgaagtatgttgactaactttactactagttacaaacgtanaaccgttacgaccgggtaccctactttacctaccgttttcccggcccgttacggaaccctacgtaacgtaactaaaacgtcctaacgaccgtaacgtgtacggctacgacctacgtacgttaccg

SEQ ID NO: 262563 - DNA, 698 bp, Homo sapiens
  misc_feature: GYAE6OF01DULQ1.35.53.E09.1.454.CMB.1.raw
  modified_base (682)..(682): a, c, t, g, unknown or other
  misc_feature (682)..(682): n is a, c, g, or t
tcagtacagatcgtcacgaccggtgctcgatttagagagagtgtgttgggtttgggggagtcagtctcagtcaggacacagcatggacatgaggctccccgctcagcctcctggggctcctgctactctggctccgaggtgccagatgtgacatccagatgacccagtctccggcctccctgtctggtgctgtcggagacagactgaccatcacttggccggacaagtcagaccgttcgcgtctatttaaattggtatcagcagaaaccgacggaacgcccctcagctcgctgtctcgtatactgtattcttacgtttcctagttccgttcggggtccctagttaccgtaaggtttacgaagttggcgtagttcgggtttcgtggggactagtacgtttaccaccgttaccttaccgtaaccttagttaccacggtacgtaacgttccgttcgaacctaaaccgttacggaaaggtaacgttcggtttaacgaaccctttaactttaacctaccgtttacgtaccaaacgtaccggtaacgttaccggacccgggttacccctacgtttaccctacccgtttccggtccccgttacgggacccgtaaccgaacggttacccgtaaacgtccccaaacggtaccggttaaaccgtcggttacggtacccgttgggaaaccccnccgtaacgtttacccg

SEQ ID NO: 262564 - DNA, 616 bp, Homo sapiens
  misc_feature: GYAE6OF01AQQ2W.35.53.E09.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (603)..(603): a, c, t, g, unknown or other
  misc_feature (603)..(603): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctgtcgganacagactgaccatctacgttcggcccgggacaagtccacggtacccgttcgccgttcttaagtttaaaattggtatcgagacaagaaaccgaggaaccncccctnacgctgctgctctatactgtatctacgttcctattcgttcgggtcccagtctaaggttcaggtcggctaggttggtcgtagggactagttactttcgaccttctctaacgttactcgacgtctacgtctaacgtacctaaaccgtgaagttcttgttacgaaccttaacctttactaactcgaacaataaccgtacttaaccgaccggtacccctagttaccgtaccgtttaccgcccgtacgggacccaaggtaccgtacgtaaacctccgaacgtaccgtaacgtcggtacgctaccncacccgttattcg

SEQ ID NO: 262565 - DNA, 740 bp, Homo sapiens
  misc_feature: GYAE6OF01EF2CL.35.53.E09.1.454.CMB.1.raw
  modified_base (203)..(203): a, c, t, g, unknown or other
  misc_feature (203)..(203): n is a, c, g, or t
tcagtacagatcgtcacgaccggtgctcgatttagagagagtgtgttgggtttgggggagtcagtctcagtcaggacacagcatggacatgaggctccccgctcagctccgtggggcctcctgctactctggctccgaggtgccagatgtgacatccagatcgaccagtcctccggcctcctgtcgtggtcgcgtggtcgganacagactacgacctatccgtacgttcggccggactaacgtccgacggtacccgttcgcgttacttaagttttaagtggtatacgagacaaacggaaaccgacgggaaccctccccgtagacgtcgtcgcgtcgtactacgttatacgtcgttacttcgttacgtttcctagtttccggttacgggtaccctaagtacgttaaacggttcgaagggttcggacgttagggtttcggttcggaacgggtactagttactttaccgaccttctacgtaactacgtacgacgtactacgtaccgtacgaaccgtagtaagtaacgtactttacggtactaaccgttaactttcgtacttaagtaaccgtaaacgttaccgtaaccgtaccggtacccgttaccttaacgtttacccgttaccgggttcccgaacccggttaccggtacccaaacggttaccggtaacgtaaaaccgttccggaacggttaaccggtacggttagtacccgtacgtaccgacccttaacgtcgtttacccgg

SEQ ID NO: 262566 - DNA, 546 bp, Homo sapiens
  misc_feature: GYAE6OF01BHDWJ.35.53.E09.1.454.CMB.1.raw
  modified_base (541)..(541): a, c, t, g, unknown or other
  misc_feature (541)..(541): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcaagaaaccagggaaccgcccctcacgctgctgctctatactgtatctatttcattcgttgggtccatctaaggttcaggtgcagttggttcgtgggacagtacttcactctactactatcagcagtctcgacctaacctgaagattggttacgactaacctttactacttacgtacaaactagtaaccttaacgtaccgggtcccctagttcctaccgtttccggccgtacgggaccacgacgtacgaactccgagaccgaacgtgtcgcctagcaccgtnttccg

SEQ ID NO: 262567 - DNA, 724 bp, Homo sapiens
  misc_feature: GYAE6OF01D0X3A.35.53.E09.1.454.CMB.1.raw
  modified_base (165)..(165): a, c, t, g, unknown or other
  misc_feature (165)..(165): n is a, c, g, or t
tcagtacagatcgtcacgaccggtgctcgatttagagagagtgtgttgggtttgggggagtcagtctcagtcaggacacagcatggacatgaggctccccgctcagctcctgggctcctgctactctggctccgaggtgcagatgtgacatccagatcgaacccngtcctcccggccttcctgtctgcatctaggtaggacaactagagtccaaccgtctacgttcggacccgggataaagtcgaagacgactaaattaaaacgaagttaaaatttaaagttggtaactcgaagacaaacggaaccgtaagggaaaacttccccgtaaggcctacctatactacttatcgtactgtccttacgttacttagacgtaagtcggtaccgggtacctagtacgtaacggtacgaggtacgtacgtacgtaggtacgtacggaggtaacgtaagtaccgttcgtacctaacgtacctacctaacgtcgaacgtccgtaagttacctaacggaacccttaacgttagttaaacgtttacgtttaacgtaaccttaaacgtttaaccttacgttaacgtaaacctacgtaacggtaacgttagtacggttacgtacccgtttacggttaaccggtcgggtaaacgggtaacgggtaaccgtaaggtaccggaactaacgtaaaaccggtaaacgtcggtacgtacgtaccgtagtacctcgtagttaccg

SEQ ID NO: 262568 - DNA, 603 bp, Homo sapiens
  misc_feature: GYAE6OF01A9WMY.35.53.E09.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
  modified_base (594)..(594): a, c, t, g, unknown or other
  misc_feature (594)..(594): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtnctgtcggagacagactgaccatcacgttgccggganaagtcagtaccgttcgcgtctatttaaattggtatcagcagaaaccagggaaccgcccctnacgctgctgctctatactgtatctagtttccattcgttcgggtacccatacgtaaggttcagtggctaggttggttcgtgggactagtactttcgacttctacgactatcacgtctacgttctacgacctaaccgtagaagtagttacgttacgactaacctttacttactacgtactaacgaacgtacgttaacgaccgggtacccctagttaccgtaccgtttccggacccgtacggacccgtaacgtacggtaccgtaaactaccgacggacgtaacgttcggtcggtacgtaccgaccgtaaccngtttacccg

SEQ ID NO: 262569 - DNA, 622 bp, Homo sapiens
  misc_feature: GYAE6OF01BZWC9.35.53.E09.1.454.CMB.1.raw
  modified_base (188)..(188): a, c, t, g, unknown or other
  misc_feature (188)..(188): n is a, c, g, or t
  modified_base (607)..(607): a, c, t, g, unknown or other
  misc_feature (607)..(607): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtnctgtcggagacagactgaccatacacttggccgggacaagtcaacgtccgttcgtcgttactaatttaaattggtactcagtacaagaaaaccgacgggaaccgcccctcacgtctgactgcctctacttaccgtgttactcttacgtttcctattccgttcggggtaccctatcgtaaaggttctaggtcggctaggttggttcgtaggggtacctagttactttcaccttacgtactacttaatccgagtactacgttctacggtacaaccgtacggtaagtaagttcggttacgaccttaaccgttactacctagtacaaacgtaagtaccttacgaccgggacctaacgttcctacgttcccggaccggtcgacctacgtacgtacgaactccgtaacgactacgtgtcgactanaccgtactcttcccg

SEQ ID NO: 262570 - DNA, 705 bp, Homo sapiens
  misc_feature: GYAE6OF01EDPA6.35.53.E09.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
  modified_base (690)..(690): a, c, t, g, unknown or other
  misc_feature (690)..(690): n is a, c, g, or t
tcagtacagatcgtcacgaccggtgctcgatttagagagagtgtgttgggtttgggggagtcagtctcagtcaggacacagcatggacatgaggctcccagctcagctcctggggctcctgctactctggctccgaggtgccagatgtgacatccagatcgacccagtcctcccggccctcccgtgtcctggtcgcgtggtcgganacgagactcgacctatcacgttcgccgggacaagtcgacgtaccgttcgcgtacttaattttaagtggtactcgagtacaacggaaaccgacgggaacccncccctgacgccgtgcctcgccttacgtaactaccgttgttaaccttcgtttacgtttaccctacgtttccggttaccgggtaccctaagttaccgttaaaggtttcgaaggttcggtacgttaacgggtttcggtacggttacgggactacggtttacttaccgtacttccgtactacttaacgtcgacgtactacgttcaacgtaccctaacgtagtaacgttacgttcgttacctaaccgttaacttacgtactacggtaacctaaacgtacgtaccttacccggaccggttacccttatcccgttaccgttacccggaccgtacgtaacctacggtaacgtacaaccttcccggaatacccgttacggtcgtaccggtcncctaccgtaccttcg

SEQ ID NO: 262571 - DNA, 585 bp, Homo sapiens
  misc_feature: GYAE6OF01CHVWZ.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtcctggtgctgtcggagacagactcgaccatcacgttcggccgggacaagtcagtaccgttcgcgttcttaatttaaattggtatcagacaacgaaaccgagggaaccgcccctacacgctgctgcttctatactgtattcttagtttccattcgttcgggtcccatacgtaacgttcaggtggctaggttggttacgtggggactaggtaattccacttctctactatacagactcgtctacgtacctaacctgtaattcttgttacgactaacttactactatacaactaacgtacctacaccggtccctacgttcctaccgttccgcccggtaggtacccaacgtacggtaaccgaacttaccacgtaccgtaagtcggtagtcaccgccactcgttaccg

SEQ ID NO: 262572 - DNA, 904 bp, Homo sapiens
  misc_feature: GYAE6OF01CSEMG.35.53.E09.1.454.CMB.1.raw
  modified_base (130)..(130): a, c, t, g, unknown or other
  misc_feature (130)..(130): n is a, c, g, or t
  modified_base (168)..(168): a, c, t, g, unknown or other
  misc_feature (168)..(168): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagtacagatcgtcacgaccggtgctcgatttagagagagtgtgttgggtttgggggagtcagtctcagtcaggacacagcatggacagtgaggctccccgctcagctccgtggggctcctgctactcnggcctcgaggtcgcagatgtgacatccagatcgacccngtcctcccggcctcctgtctggtnctggtcgganacagactcgaccatcacgttgccgggacaagtcgagtaccgttcgcgttacttaagtttaaagttggtattacgagaccaaacggaaaccgacggggaaccncccctacgacggtcctagctcgtaccttctaacttacgtagttacttaccgtttaacgtttcccgtaagtttccggttccgggggttacccctaagtttacccggtaaaagggtttcccgtaagggttcgggttaccgtaagggtttcgggtttccggttaacggggtaacgtaacggtttaacctttttaccgaacccgtttacccgttaccgttaaaccttacgtttaccggaaccgtacttaacggggttccctttaaggaaccccttaaaacccgtagggttaaacgttacggttttaggtttaacccggtaaacccgtttaaacctttttaaaccggtaaccctttaaacgggttaaccctaaaacccggttaaacgttaaaccccgttttaaacccggggaccccgggttaacccccctttacgtttaccctaccccgggtttttacccgggtacccccggtttaaccgggaaaccccgtaaccgggttaaccggtaaaccgtaaaacccgttaccccggtaaaacggttaccccggtaaacgttacgtacccggggttcctagggaaccccccttacgtacccgttttacccg

SEQ ID NO: 262573 - DNA, 678 bp, Homo sapiens
  misc_feature: GYAE6OF01D127C.35.53.E09.1.454.CMB.1.raw
  modified_base (638)..(638): a, c, t, g, unknown or other
  misc_feature (638)..(638): n is a, c, g, or t
tcagtacagatcgtcacgaccggtgctcgatttagagagagtgtgttgggtttgggggagtcagtctcagtcaggacacagcatggacatgaggctccccgctcagctccgtggggctcctgctactctggctccgagtgcagatgtgacactccagatcgacccagtcctccctccacctgtctgctatcgtaggtaggaagaagccgtacaccatacctacgtcggacccgacagtcaagtagttagttaagttagttggtcgcgtggtatacagacaagaaaccgaacggaaacctacccctaactcctagtaactttacgttaacggtcgtttaacttacgtttaaggaggtacgggttacgggtacctagtacggtaaggttcgacggtcggacgtaggtacgacttcggaggactacgtacttcactcgtaccacctactaccaccacgtcctagccacgttcctagtacttagtttacgtttcgaaccttaaccgttacttccaacgtacctaacgttaggttacgtacggtacgttacgtttacccgtcgttacccggttccgaccggtagggaaaccttaaggtacgtaacttaacgtaaacgaaacggttacgtggtacggtccgtanacccgttaacttacgttccgttacgttcctcgttaccccg

SEQ ID NO: 262574 - DNA, 604 bp, Homo sapiens
  misc_feature: GYAE6OF01CZY5K.35.53.E09.1.454.CMB.1.raw
  modified_base (386)..(386): a, c, t, g, unknown or other
  misc_feature (386)..(386): n is a, c, g, or t
  modified_base (510)..(510): a, c, t, g, unknown or other
  misc_feature (510)..(510): n is a, c, g, or t
tcagtacagatcgtcacgaccggtgctcgatttagagagagtgtgttgggtttgggggagtcagtctcagtcaggacacagcaatggacatgaggctccccgctcagctcctggggctcctgctactctggctccgaggtgccagatgtgacatccagatgacccagtctccatccctccctgtctgcatctgtaggagacagcgtacaccatcacttggccggacaagtcagagctatggactagtttactttaaagttgtatacgaaaccggaaaccgaggaaaccgaccctaaaactcctagatactatgctgctacttctatttacgacgtaaggtcgggtaccgagtaaggttcgaggtgcgtaggtgacgtgtagggaanaacgtatccactactacgaacactacagctagtctacgactaaccgtagaagttactttagaaccctaacgttactatttacacgtaaacgtacgtaacggttacaacgtacccgccgaacgtnacgtacgtccgttaccggaccgaaaggacctacggtaagtaacggtaaagtaaaacgttaaacgtacgttacgggataccgtcgaccgtaaacc

SEQ ID NO: 262575 - DNA, 658 bp, Homo sapiens
  misc_feature: GYAE6OF01DEOPN.35.53.E09.1.454.CMB.1.raw
  modified_base (297)..(297): a, c, t, g, unknown or other
  misc_feature (297)..(297): n is a, c, g, or t
  modified_base (378)..(378): a, c, t, g, unknown or other
  misc_feature (378)..(378): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctccggcctccctgtcgtggtgctggtcggagacagactgaccatcacgttcggccgggacaagtcacgtaccgttcgcgttacttaagtttaaattggtatcacgacaacgaaaccgacgggaaccncccctagacgtctgctcgcttactatacttgtacttcttacgtttcctatcggttcggacctatcgtaagttcagtcggtntaggttcgttcgtagggactaggtactttacacgttcctaactacttactaccaggtactacgttcctacggaaccgtaaacgtagaagttacgttcgttacgaaccgttaactttactacgtataacgaactaaccgtaccgttaacccgaccggtaccccttagtttcccgtacggttcccggtaccgaacgggaccctaacgtaacgttaaccggaacttaccggagtaacccgtaggttccgtacgggtactaccgaaccttaacctgtttacccg

SEQ ID NO: 262576 - DNA, 612 bp, Homo sapiens
  misc_feature: GYAE6OF01ASB33.35.53.E09.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (569)..(569): a, c, t, g, unknown or other
  misc_feature (569)..(569): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtcgccagatgtgacatccagatcgacccagtcctccggcctcctgtctggtgctgtcgganacagactgaccatcacttcggccggnaagtcacggtaccgttcgacgtctaatttaattggtatcagactaagaaaccgtaggaaccgcccctcagcgtgcgtacgctctactactcgttatacgttacgtttaccacgttccgtttggggtaccctatacgtaaggtttcgaaggtgtcgtaggttcggttcgtacgggactagtattcacgtctacgactatcagtcaacgttctacgactaacctagtaacgagttgtcgtactaacgttactactacgtacaacgtactaaccttaaccgaccgggtaccctattaccgtaccgttccggtcccgtaacgggtaccaaccgtacgtaccgtaaacncgacggaccgtaaccgtggtccggcagccctaccgtaattccg

SEQ ID NO: 262577 - DNA, 633 bp, Homo sapiens
  misc_feature: GYAE6OF01DFB9S.35.53.E09.1.454.CMB.1.raw
  modified_base (300)..(300): a, c, t, g, unknown or other
  misc_feature (300)..(300): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (627)..(627): a, c, t, g, unknown or other
  misc_feature (627)..(627): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctccggccttccctgtctggtgctgtcggagacagactcgaccatcctacgttcggccgggacaaggtccgaacgtaccgttcgcgttacttaatttaaagttggtatcagacaacgaaaccgaggaaccncccctagagcctgctcgtctactactctgtactctttacttctacttcggttaccggtacctagttacgtaaggttctagggtcgtacgtaggtttcggtcgtacgggtacttagtactttccncttacctanaccttagctacgtaccgtagtctacgaacctaacgtaagagttattcggttactaacttaccgtttactacgtacgtaaccaactacgttaaccgtaccgaccggtccccttagttcctacccggttccgacccggtagaccctcgaacgtaacctagacgtacgaccgtagtcggtctacgactacctacctnttaccg

SEQ ID NO: 262578 - DNA, 889 bp, Homo sapiens
  misc_feature: GYAE6OF01EZA23.35.53.E09.1.454.CMB.1.raw
tcagtacagatcgtcacgaccggtgctcgatttagagagagtgtgttgggtttgggggagtcagtctcagtcaggacacagcatggacatgaggcctccccgctcagctccgtgggctcctgctactctggctccggaggtgccagatgtgacatccagatcgaccctagtcctcccggccctccctgtccgtggtcgtcgtggtcggagaccgagtaccgttacgaaccctagtaccgtaccgttcggacccgggtacaaacggtccgtaacgtacccccggtttcgacgtttaacctttaaagtttttaaaacggttggtaactaccgtaaggaccgaaaaccggaaaaccccggaaggggtaaaccccctccccccgttagtaaccggtccgttacggtcccgttacggtaccttaccgtttaacgttaacccgtttaggttaaccttttacgtttaacccgtttttacccgaacgttttcccgggtttacccggggttaacccctaagttaacccggttaaacgggttacgtacggggttaacggtccggttaggtttacggggttaccgtaggggtaaaccttaggtttacctttaccgtaaccctcttaaccgtaacgttactacgaacgtcgtaacgttcctacgtaacctaacgtaacggtaagttcgtacggttaccgtaccttaaaccgtttaccgtacgtagtaacccgtaaacgtaaccggttaccgtttaacccgaccggttaccccttaagtttaccggtaacccgtttcccgggaacccgtttaacgggaccctaaccggttacggaacccgtaaacgtacccaaggtacccgtaagttcccggtacgcccgttaagccccttacgtcgttccg

SEQ ID NO: 262579 - DNA, 656 bp, Homo sapiens
  misc_feature: GYAE6OF01EECRI.35.53.E09.1.454.CMB.1.raw
  modified_base (200)..(200): a, c, t, g, unknown or other
  misc_feature (200)..(200): n is a, c, g, or t
  modified_base (481)..(481): a, c, t, g, unknown or other
  misc_feature (481)..(481): n is a, c, g, or t
  modified_base (649)..(649): a, c, t, g, unknown or other
  misc_feature (649)..(649): n is a, c, g, or t
tcagtacagatcgtcacgaccggtgctcgatttagagagagtgtgttgggtttgggggagtcagtctcagtcaggacacagcatggacatgagctccccgctcagctcctggggctcctgctactctggctccgaggtgccagatgtgacatccagatcgacccagtcctcccggcctccctgtctggtcgctgtcgganacagactgaccatctacgttcgccgggacaagtcacgtaccgttcgacgttacttaattttaaagttggtaactcaagtcaaacgaaaaccgaggggaaccctcccctacagtctcggctgcctactagtacttgtaacttcgttaacgtttccaactttccggttcgggtaccctagtaccgtaaggtttcgaggtcggctaggttcggtttcgaggggacaggttatttccactcgtactactacgtacagtctagttctagacctaacgtagaacgtnttcgtactactaacttctacgtacgtacaacgtaacgttaccgtaaccggaccggttacccttaacgtttcctacccggtttaccggcccgttaccggacccgtaaacgttacggtaccgtaaattcccggaagccgtaaacgttcggtcggtactacgacccgtacnctttccg

SEQ ID NO: 262580 - DNA, 782 bp, Homo sapiens
  misc_feature: GYAE6OF01BOXD2.35.53.E09.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
  modified_base (350)..(350): a, c, t, g, unknown or other
  misc_feature (350)..(350): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctccggcctcctgtctggtnactggtcgganacagactacgaccatccacgttcggccgggactaacgtcgacgtaccgtttcgaccgttacttaagtttaaagttcggtatcaagacgtaaacgaaacccgaggggaacccncccctacgacgctcgtccttggccttcgttatacgttnttacttcttacgtttcctacgttcggttcgggtaccctagttacggaacggttcgaggttcggtacgtaggttcgggtttacggacgggtactaggttacttttcccacgtttctaaccgtaacttactaccgacgtacgtacgttcccgtacgtaacccgttaaaccgaggtaacgtttaggttaccggttacggtaaccctttaaccttttaaccggttaaccgttaccggttaaccaaacggtaaccggttaaccggttaaccgtacccccgggtaccctttacgtttacccggtaccccgttttaccccgggacccgggttacccgggaaccctaaccggtaccggtaacccgttaaaccggtacccgaacggtaccgtaaaccgtcggttaccgaccgttacgaccccttactacggtttaccccgg

SEQ ID NO: 262581 - DNA, 731 bp, Homo sapiens
  misc_feature: GYAE6OF01D9SOQ.35.53.E09.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagtacagatcgtcacgaccggtgctcgatttagagagagtgtgttgggtttgggggagtcagtctcagtcaggacacagcatggacatgaggtcccgctcagctcctgggctcctgctactctggctccgaggtgccagatgtgacatccagatgacccagtctccatcctccctgtctgcatctgtagagacngcgtacaccatcacttgccggacaagtcagagtctagttggactagtttacttaaattcggtatacaacggaaaccgaagggaaacnccccttaaactccgtagattactaagtgtctgactacttacctagtttcgacgtaaaggtcgggtaccccgtactacggttacgaggttgacgaggtacgtaagtcggtagggactaagtacgttacctacgttacctaccaacctaagtccctaacgacgtacgttacgtcgaaccgttaaccgttaagtaacgttacgtttttcccggaaacccttaacccgtttaaccgttaacgttttaccgtaacgtaaaccgtttaaaggttaaccgttttaaacccgtacgggttaaaccccggccccgggtaataaccgttacgtaaacccggttcggtttaacccgggaacccggtaaaaggggtaaccctaaccggttaggttaacggtaaacgtaaaaagtttaaacgaccggtttggttaccgggacttacgaccgaacttaacgg

SEQ ID NO: 262582 - DNA, 968 bp, Homo sapiens
  misc_feature: GYAE6OF01EWFTQ.35.53.E09.1.454.CMB.1.raw
  modified_base (320)..(320): a, c, t, g, unknown or other
  misc_feature (320)..(320): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgaccccagtcctcccggcctccctgtctggtgctggtcggagacagactgaccatcacgttcggcccgggacaagtccacggtaccccgttcgacgttacttaagttttaaagttggtaactcgaacgaccaaacggaaaacccgaacggggaacccccncccccttacgacggtccgttacgccttacggtcccttactttaacgttaccgttacgtttaactttaccgtttaccgttttccctaacggtttttccccgggtttaccggggttacccctaagtttaccggttaaacggtttcgaacgggttccggtacgtagggtttcgggtttacggtacggggtaaacgttacgtttaacctttacctaccgtttacccgttactaaacccttacgtacccgtaacggtaccgtttaacgggttaccccgttaccggtaaccccgttaaaccgggttaaggtaaaccggtttagtttacccggttttacgtaaacccccgtttaaaccttttaacccgttttaaccggtaccgttaaaccctaaaccggtaaccgttaaccccgtttaaacccgggtaccccgggttaaccccctttaacgttttacccccggttacccgggttttacccccgggaccccgggtttaacccggggtaaaccccttaaacccggggttaaaccggtttaaacccccggtaaaacccgtttaccccgggtaaacgggttaccccggttaaacggttccggggttaaccgggtcccgttaaacccgtaccccctttaacccgtaccgtttttcccccg

SEQ ID NO: 262583 - DNA, 697 bp, Homo sapiens
  misc_feature: GYAE6OF01DS0K6.35.53.E09.1.454.CMB.1.raw
  modified_base (490)..(490): a, c, t, g, unknown or other
  misc_feature (490)..(490): n is a, c, g, or t
tcagtacagatcgtcacgaccggtgctcgatttagagagagtgtgttggggtttgggggagtcagtctcagtcaggacacagcatggacatgaggctccccgctcagctccgtggggctcctgctactctggctccgaggtgccagatgtgacatccagatcgacccagtcctccggcctcctgtctggtgctggcggagacagactgaccatctacgttcggccgggacaagtccgacggtaccgttacggcgttacttaattttaaagttacggtatcgaagacgaaacgaaaccggacgggaacccgtcccctcgaacgtcctggccttcgtcctacttaataccgtttagttacttcgtttaacgtttacctacgttccggtttccgggtaccctagttacgtaacggttcgtacggtcggtcgtacggtttggttcgtagggacgtagttacttctactctactactatacgagtctacgtctanaacctaaaccgtagtaagtagttctacgtaaccttaacttactactacgtactaactacgttaaccgttaaccggcccggttaccctacgtttaccgtacccgtttccgggtacccgtacgggtaaccctaagggtaccgtaaccggtaaactccggtacgaaccgtacggttacgggtcggtacgacgaccctaagtccgtttacg

SEQ ID NO: 262584 - DNA, 830 bp, Homo sapiens
  misc_feature: GYAE6OF01EY1E4.35.53.E09.1.454.CMB.1.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (816)..(816): a, c, t, g, unknown or other
  misc_feature (816)..(816): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctcccggcctccctgtctggtnctggtcgganacagactcgaccatcctacgttcggccgggtacaaacggttccgaacggtaccccggtttcgaccggtttacttaaagttttaaaacttgggttaactaccgaagaccgaaacgaaaacccggtaacggggaaccccgtacccccgttacgacggtccttcggaccgttccggtaccttaccgtttaagttaaccctttagggtttaactttaccgtttaaccggttttacctaacggttttccgggtttaccgggggttacccctaaggttaaccggtaaacgggtttaccgtaaggggttcgggtaccgttaacgggttttcgggggtttacccggttaagggggtaaccttaacggtttaaccttttaccgtaaccgtttacccgttaacctaacgttaacccgtccgtaacgtaccgttacggttacctacggtaaccccgtaacgttaggaacgttacgttggttaactaccgttaaacctttacgtacgtaccgaactaacgtaccgttaaccgtacggtacccggtacccttaacgttcccgttacgttaccgggcccgtacgggtaccaacgtacgtacgaacctccgagtaccacgtgtcgactancctaactgttaccg

SEQ ID NO: 262585 - DNA, 561 bp, Homo sapiens
  misc_feature: GYAE6OF01EBS9T.35.53.E09.1.454.CMB.1.raw
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (413)..(413): a, c, t, g, unknown or other
  misc_feature (413)..(413): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggcctccgaggtgccagatgtgacatccagatgacccagtcctccggcctcctgtctggtgctgtcggagacagactgaccatcacttcgccggcaagtcagaccgttcgcgtctatttaattggtatcagcaagaaacgacggaacncccctcngctgctgctctatactgtatcttagttctacttcgttcgggtccctagtacgtaaggttcagtggctagttggttcgtgggactagtattcactctctactactcagctacgtctcgactaactgaagtntgttacgactaactttactactgactaactacgtacttaccgtaccggtaccctacgttcctacgttcccggtcccgtacggacctacgtacgtaacgtaacgtaccacggaccgtaacgtcgtcggtacctcgacctccgtcttccg

SEQ ID NO: 262586 - DNA, 648 bp, Homo sapiens
  misc_feature: GYAE6OF01BEAJH.35.53.E09.1.454.CMB.1.raw
  modified_base (197)..(197): a, c, t, g, unknown or other
  misc_feature (197)..(197): n is a, c, g, or t
  modified_base (634)..(634): a, c, t, g, unknown or other
  misc_feature (634)..(634): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctcctgtctggtgctgtcgganacagactgaccatcacttcggccgggacaagtcacggtacccgttgcgttacttaattttaaagttggtatcagtacgaacgaaaccgaacggggaacccgcccctacacgctcggctgctactatactgttacttcttacgtttcctacgtttcgttcggggtccctaagttaccgtaaggttcaggttcggacgtaggtttcgggttacgtaggggtaactaggttactttactacttcgtacctatacttacagtactacgtctacgtaccaacgtacgaagtgttagtctaaccgttaacgtttactacgttacgtaacaacgtaactaccgttaaccgaccggtacccttacttccttaaccggttcccgtacccggtacggacctaacgacgtaacgaacctacgacgtacgacgttacgtcggtactacncctacgtcgttacc

SEQ ID NO: 262587 - DNA, 554 bp, Homo sapiens
  misc_feature: GYAE6OF01BEZ02.35.53.E09.1.454.CMB.1.raw
  modified_base (417)..(417): a, c, t, g, unknown or other
  misc_feature (417)..(417): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaaccgcccctcagctacgctgctctatactgtatctagtttccattcgttcgggtcccagttcgaaggtttcaggtcggctaggttggttcgtgggtacagtatttcacttctacactatcagtcagtctgactaaccgtgaagtntcgttagactaacttactactgtacaacgagtacctacgtaccggtccctattccgtacgttccggccctacgggacctacgtacgtacgaaactccgacgaccgtaacgtcgtacggctacggcctacgtattccg

SEQ ID NO: 262588 - DNA, 865 bp, Homo sapiens
  misc_feature: GYAE6OF01ER49H.35.53.E09.1.454.CMB.1.raw
  modified_base (842)..(842): a, c, t, g, unknown or other
  misc_feature (842)..(842): n is a, c, g, or t
  modified_base (852)..(852): a, c, t, g, unknown or other
  misc_feature (852)..(852): n is a, c, g, or t
tcagtacagatcgtcacgaccggtgctcgatttagagagagtgtggttgggtttgggggagtcagtctcagtcaggacacagcatggacatgaggcctccccgctcagcctccgtgggctcctgctactcgtggcctcggaggtcgaccagatgtcgacactccgaagacgtcgaaccccgtcggttcccgtaccccggtccccttcccgtggttaccggttcgggtcggtacccgttaggggtacgggaacgaacgtacggtaacctaccgaacccttgtaaccgttaccggttcgggacccggaactaacgtaccgtacgggttacccgtttacggtaacctttacgttttaaaacgtttagttacggtactaccgaacgaaaccgtaaaccggaaaccggaaccggtaaccccgtccccgtaagtaccgtctccggtacgtccgttacctacgttaagttacgttacttactttcttacggttctacggttcggtaccgtacctagtaacgttgtaggtcgtcgtaggtaggttcggaggtaacgtacgtctttacttacgtaaccttcgaacctattaaccgtaccgaggttaccctaacgttcccgaaccgttaacgtaacgtaagggttaactttggttaaccctttaaccgtaacttttaacccgtttgttacccgtaaacgtttaaacccgaaccgtttaaacccggttacccggaaacccgtttaccccggtaacccttttaccgggttaacccgttacccgggttccgggtaaaaccccgtcgacccgtaaaacgtttccgaaacttaaccgtacggcgttacgagggtccnccgtacaccncgttcgtactccg

SEQ ID NO: 262589 - DNA, 794 bp, Homo sapiens
  misc_feature: GYAE6OF01EDEFE.35.53.E09.1.454.CMB.1.raw
  modified_base (768)..(768): a, c, t, g, unknown or other
  misc_feature (768)..(768): n is a, c, g, or t
  modified_base (781)..(781): a, c, t, g, unknown or other
  misc_feature (781)..(781): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccggaggtgccagatgtgactatccagactcgacccagtcctcccggtcctccctgtcgtggtgtcctgggtacgggacacgacgtacgaccactactaccgttcggtaccggtacgacgtacgtaccgtaccgttaccgtcggttacctttaagttttaaacgtttaggttactactaggacctaacgaaaccggtaaccgggtaaccccgacccctcctcggtacgtacgtcctcgtaccgtacttacgtaacgttcgtttacttacgtttacgtttacccgttacgttacgttaccggggttcctactaggtacggttagtaggtcggtggtacgttgggtttacgtacgggtattacgtatttaccgtaccttcgtaccttacgtactacgactacgtacgttacgttacggtaactaacggtaacgtaaacggttcgttagttaccgttacgttaacccttactttaacgtacttacgtaacgtaaccggtaacttaacccgtacccgggtaccctaacctttacccttacccgggtttcccggtcccggtaacccgggtaaccgtacccggtacgttaaacccggaacgttaaccgtcccggaacgttaccggtcgtcggtaacccgtntaacccttaaccncgtttctacccgg

SEQ ID NO: 262590 - DNA, 701 bp, Homo sapiens
  misc_feature: GYAE6OF01AR6M5.35.53.E09.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (307)..(307): a, c, t, g, unknown or other
  misc_feature (307)..(307): n is a, c, g, or t
  modified_base (689)..(689): a, c, t, g, unknown or other
  misc_feature (689)..(689): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtcgactatccgagtatcgacccagtcctcccggcctcccgtgtctggtcgctggtcgganacgagactcgaccatccacgttcggccgganaagtcaacggtccgttcgcgtacttaattaagttggtatcagcaacgaaaccgacgggaccgcccctanacgctcgactgctactatctgtactacttgttctattcggttcgggtccagtacgtaacgttcaaggtcgactaggttgttacgtacgggtactacggttattaccgtacttcgtctaacgtcgtaccgagtaccgtaagttccgacgtaacccgtaacgtaggtaacgttacgttaggtttaacgtaaccgtttaaccttaacttacgttacgtaactaacggtaaccgttaacgtacccggtacccgtacccttaacgtttaaccccgtacgtttacccgggacccgtacggtaaccccgtagtaacccggaccgttaaactacccggtacggtaaccgtaccgttacggtaccggtcccgtaacgtacccgaaccgttntttacccccggg

SEQ ID NO: 262591 - DNA, 716 bp, Homo sapiens
  misc_feature: GYAE6OF01DPQ4D.35.53.E09.1.454.CMB.1.raw
tcagtacagatcgtcacgaccggtgctcgatttagagagagtgtgttgggtttgggggagtcagtctcagtcaggactacagcatggacatgaggctccccgctcagctcctggggctcctgctactctggcctccgaggtgccagatgtgacatccagatcgacccagtctccggcctcctgtctggtgctggtcggagacagactcgaccatccacgttcggccgggacaacgtcgaacggtaccgttccgacgttacttaagttttaaacgttggttaactcgaacgacgaaacgaaaaccgacggggaaaccgtccccctagacgtcgtcgcctgtcctaccttagtaacttcgttaactccgtttaacgtttccctaacgtccggtttccggggtaccctacgttaccggtaaggttccgtaggtcggtacgtaggttcggttcggtagggacctagtacgtttcctaaccgttctactaccgtatacgtacgtacacgttctacgactaaaccgtgaacgtattcgtacgaacttaaccgttaactacgtagtaacccaataaccgtacgtttaaacccgaccggtaccccttagttacccgttacccgtttacccggcccgttaccggacccaaacggtaacgttaaccggaaactcccggaacgtaccgtaaacgtcggtacgacgtaacgccctaaacgtcgttacg

SEQ ID NO: 262592 - DNA, 815 bp, Homo sapiens
  misc_feature: GYAE6OF01AOWWY.35.53.E09.1.454.CMB.1.raw
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtctcccggcctccctgtctggtgctgtcggagacagactgaccatcacgttcggccgggacaagtcacgtaccgttcgctcttaatttaaagttgtatcagcaagaaaccgagggaaccnccccgtnacgctcgctcgccttacgtactactgttacttcgttacgtttccacgttccggtttacggggtccctagtacgttaacgggttcaagggtcggtacgtaggttcgggttcgtacggggtaactaggttacttttacccgaccttccgttaccttaacttacgtaccgacggtacgtacggttcctaccgggtaaccctaaaccgttaggaaacgtttacgttacgggtttaacgaacccgtttaaacccttttaaccgttaccgtttaacgttaaccgaaacccgttaaggtaaacccctttaaccggggaaccccgggtttcccccttaaacccgtttttacccggttaccccgggtttcccccgggtaaccccggtttacccggggtaaacccctaaccgggttaaaccccggtttaaccgggaaaaccccgttcccgggttaaacggttaacccccgggtaacgtttacgggtcccgggttaccgttacggaccccttaacccggtccttttacccgg

SEQ ID NO: 262593 - DNA, 617 bp, Homo sapiens
  misc_feature: GYAE6OF01EOVSR.35.53.E09.1.454.CMB.1.raw
  modified_base (282)..(282): a, c, t, g, unknown or other
  misc_feature (282)..(282): n is a, c, g, or t
  modified_base (567)..(567): a, c, t, g, unknown or other
  misc_feature (567)..(567): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttggccggcaagtcagtaccgttcgcgttctaatttaaattggtatcagcaacgaaaccgagggaaccncccctcagctgctgctctatactgtattcgttactttccagttccgttcgggtcccagtacgtaaggttcaggtggcgtaggttcggttcgtagggtactagttactttccacttctactactactcaagctagttctacgacctaaccgtgaagtgttcgtacgtaccttaactttaccgtacttagtaaccaacgtaacgtaccgtaccggaccggtaccccttagttacctacccgtttcccgggtacccgtacgggaccctacgtaacgtacccgtaaacncccgtacggaccgtaaccgtcgggtcgtcctacgaccctaccgtgttccg

SEQ ID NO: 262594 - DNA, 860 bp, Homo sapiens
  misc_feature: GYAE6OF01ECBOP.35.53.E09.1.454.CMB.1.raw
tcagtacagatcgtcacgaccggtgctcgatttagagagagtgtgttggggtttggggggagtcagtctcagtcaggacacagcatggacatgaggctccccgctcagcctcctggggctcctgctactctggctccggaggtgccagatgtgacatccagatgacccagtcctcccggccttcctgtcgtggtcgctgtcggagacagactgaccatccgacttcggccgggacaagtccgacggtacccgttcgaccgttacttaatttaaacgttggtatacgaagtaccgaacgaaacccggacgggaaccgccccctacgacgtacgtcgccgttagtcctacttaacgtacttacgttaacttacgtttacgtttacccacgttttccgggtttaccggggtaccctagttaccgttaaaggtttaccgagggtacggtcgtaacgggtttcggttaccggttagggacgtacgtttaacgttaccgttaccttccgttaactacgttactaccgaagtccgttacggttaccgtacgaacctaaaccgtaggtaacgttacgtttacgttaaccgtaacctttaaacctttaacctttaacgtaccggttaacctaaacggttaacccggttaaccgtttaaacccgggtaaccccggggttaccccttaacgttttaccccgttaaccccgggtttccccgggtaacccggttaacccggggaaacccgtaaaccggttaacgggtaacccggttaaaaccgtccccgggtaaagggtaacccgttaaaccggtttaccgggttacggtacccgggttaccgaaccccgttaacccgtccgttttaaccccg

SEQ ID NO: 262595 - DNA, 830 bp, Homo sapiens
  misc_feature: GYAE6OF01ALW05.35.53.E09.1.454.CMB.1.raw
  modified_base (102)..(102): a, c, t, g, unknown or other
  misc_feature (102)..(102): n is a, c, g, or t
  modified_base (548)..(548): a, c, t, g, unknown or other
  misc_feature (548)..(548): n is a, c, g, or t
tcagtacagatcgtcacgaccggtgctcgatttagagagagtgtgttgggtttgggggagtcagtctcagtcaggacacagcatggacatgaggctccccgntcagctcctgggctctgctatctggctcgaggtgccagatgtgacatccagactcgacccagtccgtccggccctccgtagtcgttggtcgcgtacggtcggaagaccgtaacgacgtgaaccctagtaccgtaaccggttacggacccggaactaacggtccgtaacgggtaccccgttacggtaccgtttactttaaaagtttaaacgttagtaactacgaacgaccgtaaacggaaacccgtaacgggaacccctcccgtaagaccggtacgttacgccgttacggaccttacgtaacgttacgttacgttactttaccgtttacgtttacctaccggttccggttttaaccgggtaccctaaaggtttaccggtaaggttcccgtaaggtccggtacgtagggtttaccggtggttaacgggaccttaacgttcgtttaccnccgttacctactacgtacgtaccgacgtaccgttcgaccgttaacgtaccgttaaacctacggtaacgttcggtacttaaccgtaacgttaacgtttaccgtacgtaccgtaaccttaacggtaaccctacgggttaacccaccgggtttaacccttcgggttaacccttccggtacccggtaccggtacgtacccgtaagaccggttaaaccgtgtaaacccggtacgtacggtaaccgttcgggtacccgtcgtacgaccccgttaagttccggttaccg

SEQ ID NO: 262596 - DNA, 821 bp, Homo sapiens
  misc_feature: GYAE6OF01B8KFJ.35.53.E09.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctcccggcctccctgtctggtgctgtcgganacagactgaccatcacgttcgccgggacaagtcaacggtaccgttcgacgttaccttaattttaaaattggttaatcgaacgacaacggaaaaccgaacggggaaacccncccccttacgacgtctcgcttggccttactataccttgtacttcgttacgtttccacgttccgtttacggggtaccctaagttacgtaacggttcgtacgggttacggacgtaagggtttcgggtttacgtacggggtaacgtaacggttaaaccttttccgtaacctttcccgttaaccctaaacttttaccgtaacccgtaacgggtaccttaacgggtttaccccgtaccggttaacccgaaaacccggtttaggaaacggttaccgttttacggtttaaccggttacccctttaaaaccgtttttaacccgtaacccgtttacggttaaaccctaaaacgtaaccggtttaaacctttaacccgggtaacccgggtacccccttaacgtttacccgttaacccgttttcccgggacccgttaccgggaaaccctacgtaacgttaacccgaagttcccgaacggaccgttaaaccgtggttacggtcctaggccctacgtatttacccg

SEQ ID NO: 262597 - DNA, 741 bp, Homo sapiens
  misc_feature: GYAE6OF01AT6R6.35.53.E09.1.454.CMB.1.raw
  modified_base (226)..(226): a, c, t, g, unknown or other
  misc_feature (226)..(226): n is a, c, g, or t
  modified_base (672)..(672): a, c, t, g, unknown or other
  misc_feature (672)..(672): n is a, c, g, or t
  modified_base (714)..(714): a, c, t, g, unknown or other
  misc_feature (714)..(714): n is a, c, g, or t
tcagtacagatcgtcacgaccggtgctcgatttagagagagtgtgttgggtttgggggagtcagtctcagtcaggacacagcatggacatgaggctcccgctcagctcctggggctcctgctactctggctccgaggtgccagatgtgacatccagatgacccagtcctccggcctcccgtgtctggtgctggtcggagacaggactgaccatcacttggccgggnaacggtcaacggtaccggttcgtacggtactaagttttaaagttggtaatcaacggacgaacggaaaacccgtagggaacccgtcccctagagtctacggacttcggtacctacttaactacttaggttacttaccgttttaacggttaccctagtttaccggttaccggggttacccagttacgtaaacgggtttacgaagtttcgggactttacggttccgggttaagttacggggtaaacctaggttaaccttttaccgaccttaaccctaccgtttaacctaaagttccgaaccgtcgttaacggttacttaccgaaccgtaaaaccgttagggaaaatcgtttacgggtttaacaaaccgtttaacctttaacccgtagttacgtaaaccaaccggtaataaccgttacggaccggtaccctatttacccgacgttcccgngaaccggacctaaccggagtaaaccataccgagtacgtacgngttacgacttaccgattaacgtgtacc

SEQ ID NO: 262598 - DNA, 780 bp, Homo sapiens
  misc_feature: GYAE6OF01AC114.35.53.E09.1.454.CMB.1.raw
  modified_base (243)..(243): a, c, t, g, unknown or other
  misc_feature (243)..(243): n is a, c, g, or t
  modified_base (337)..(337): a, c, t, g, unknown or other
  misc_feature (337)..(337): n is a, c, g, or t
  modified_base (667)..(667): a, c, t, g, unknown or other
  misc_feature (667)..(667): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccggaggtcgccagatgtgaacactccagatcggacccagtccgtcccggccctccctgtcgtggtcgcgtggcggagacagacctacgaccatctacgtcggcccggganaacgtcgtacgtaccggttcgtaccggttactttaagttttaaagttgggttactacggaagtaccgaacggaaacccggacggggtaaccccnccccgtaacgtaacgtctacgtctcgtaccttactacgttacgttacgttacgttaccgtttaaccgtttcctaacgttttccgggttaccgggttaccctaacgttaccggttaaggttcgtaggttcggaacgttacggttcggtacgttacggtacgggacgttaaggtaacctttcctaccgttaccctaccgtaacctactaccgtacgccgtacttccgtaacgaccttaacgtaggtaactttacgttacgtaaccctaaccgttacgttacgttacgtaacgtaacgagttaacgtaaccgtaccggtaccacccggttaanaccgttaccggtaccggttcccggtaaccggtaccggaaaccggttaccgacgggttaacgtacggtaaagtaaacgtaaaagtcggttacgacggtctacggtcctaaccgg

SEQ ID NO: 262599 - DNA, 852 bp, Homo sapiens
  misc_feature: GYAE6OF01B7LIS.35.53.E09.1.454.CMB.1.raw
  modified_base (817)..(817): a, c, t, g, unknown or other
  misc_feature (817)..(817): n is a, c, g, or t
  modified_base (827)..(827): a, c, t, g, unknown or other
  misc_feature (827)..(827): n is a, c, g, or t
tcagtacagatcgtcacgaccggtgctcgatttagagagagtgtgttgggtttgggggagtcagtctcagtcaggacacagcatggacatgaggctccccgctcagctccgtgggctcctgctactcgtggcctcgaggtcgccagatgtgacatccgagatcgaccctagttccgtcccggccttccgtgttccgtgggtcgcctggtaccggagacgacgactcgaacctatacgtacggttcggccggactaacggtcgacggtaccgttctacgttactttaattttaaacgttggtaactacgaacgaccgaaacggtaaaccggtaaccggggacccctacccccgtacggacggtccgtacgtccgttcgtaccttacgttacgttacgtttacgtttaactttaccgtttacggtttaccgttaccggtttcgggtttaccgggtaccctaaacggtttacggttaaacggggtttacctaggggttacggtacggtttaccgggttttagggtaccggttaaccgggtaccgtttaagttttacctttacccggtaccttacccttaaccgttaaccgtacgttaccgtaacgtccgtttacggtacctaaccgtaaccgtaaggtacgtaaggttacgttacgttacctaaaccgtttacgttacgtaacgttaccgaacgtaacgtaaaccggttacccgtaccgggttacccgttacctttaccgtttaccggtcccggtttaccccggtccggaacgtacccgaacgttaacgtaccgaccgttacggtccgtaacgggttacncccgggttanaccgtaccgtacctccgttgttccg

SEQ ID NO: 262600 - DNA, 496 bp, Homo sapiens
  misc_feature: GYAE6OF02IRQH6.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttggggtcccatcaaggttcagtggcagtggttctgggacagatttcactctcactatcagcagtctgcaacctgaagattgttgacaactttactactgtacaacagtacttacagggccccattccactttcggccctgggaccacagtacaatccagcgaactgtcggctgcaccatcc

SEQ ID NO: 262601 - DNA, 485 bp, Homo sapiens
  misc_feature: GYAE6OF02GM77K.35.53.E09.1.454.CMB.1.raw
  modified_base (422)..(422): a, c, t, g, unknown or other
  misc_feature (422)..(422): n is a, c, g, or t
  modified_base (482)..(482): a, c, t, g, unknown or other
  misc_feature (482)..(482): n is a, c, g, or t
tcagtacagatcgtcacgaccggtgctcgatttagagagagtgtgttgggtttggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttggggtccatcaagttcagtggcagtggttctgggacagacttcactctcaccatcaccagcctgcagcctgatgattttgcaacctattactgccaacagtatggtnattccgtcactttcgccctgggaccaagtggatatcaaacgaactgtaggctgcaccatntcg

SEQ ID NO: 262602 - DNA, 525 bp, Homo sapiens
  misc_feature: GYAE6OF02HBREX.35.53.E09.1.454.CMB.1.raw
  modified_base (393)..(393): a, c, t, g, unknown or other
  misc_feature (393)..(393): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtccatcaagttcagtggcagtggtctgggacagattcactctcactatcagcagtctgcaacctgaatatgttnacaacttactactgtacaacagtacttaacgacgggacccctattaccgactttccggacccgttcgggacctacgacgtacgaaactccgaacgaccgaacgtcgtacggccgtacgaccaccgtattccg

SEQ ID NO: 262603 - DNA, 586 bp, Homo sapiens
  misc_feature: GYAE6OF02JGLZU.35.53.E09.1.454.CMB.1.raw
  modified_base (398)..(398): a, c, t, g, unknown or other
  misc_feature (398)..(398): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccaggaacgcccctcagctgctgctctatactgtatctagtttccatcttgggtccatcaaggttcagtggctagtggttctgggacagtatttcacttctcactatcagcagtctgcaacctgaatgtgttnactaacttactactgtacaactagacctttaacgacgggtcccctagtttacctaccgtttccggtaccccgttacgggtaccctaaccgtaccggttcccctaaacgttaaaccttaccccgtaaacccggtaaaccgttacgggttacgggtacccgttaggaccccttaccctacgtttacccgg

SEQ ID NO: 262604 - DNA, 556 bp, Homo sapiens
  misc_feature: GYAE6OF02HHGJC.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctattaaattggtatcagcagaaaccagggaacgcccctcagctgctgctctatactgtatctagtttccatcttgggtccatcaagttcagtggcagtggttctgggacagatttcactctcactatcagcagtctgcaacctgaagatgttgctaacttactactgtaccaacaacgtacttaacacgggtcccctaatttcctaaccgttttccggaccccgttcggggtaccctaacgacggttaccggtaaaaccgtccctaacggaccgtaaaccttcggtacggaccgttcgaccacccgtaattcccg

SEQ ID NO: 262605 - DNA, 505 bp, Homo sapiens
  misc_feature: GYAE6OF02HP7EH.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttggggtccatcaagttcagtggcagtggttctggacagatttcactctcactatcagcagtctgcaactgaagattgttgctaacttactactgtcaaacagacttacgacgggccctattcctactttccggccctcgggaccacgtacgtcgaaactccagacgaacgtgtcggctgaccacattccg

SEQ ID NO: 262606 - DNA, 488 bp, Homo sapiens
  misc_feature: GYAE6OF02I5ZB4.35.53.E09.1.454.CMB.1.raw
  modified_base (391)..(391): a, c, t, g, unknown or other
  misc_feature (391)..(391): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtccatcaagttcagtggcagtggttctgggacagtatttcgacttctcactatcagcagtctgcaactgaanattgttgacaacttactactgtacaacagtacttacgacggccctattcactttcgcctggaccanacgtcgaaactcgancgatgngctgcacntc

SEQ ID NO: 262607 - DNA, 556 bp, Homo sapiens
  misc_feature: GYAE6OF02JFFWJ.35.53.E09.1.454.CMB.1.raw
  modified_base (393)..(393): a, c, t, g, unknown or other
  misc_feature (393)..(393): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtaatcagcagaaaccagggaacgcccctcagctgctgctctatactgtatctagtttccattcttgggtcccatcaagttcagtggcagtggttcgtgggacagatttcactctcatatcagcagtctgcaacctgaagnttgtcgcaacttacttactcgtacaacgaagtaccttacaacgggtcccctaattcctacccgttttcggacccgttcgggaccctacgaacggttacccggtaaaatcccgtaaggaccgtaaccgttaggtcgggtaccttggacctacccgaatttcccg

SEQ ID NO: 262608 - DNA, 525 bp, Homo sapiens
  misc_feature: GYAE6OF02HVQ04.35.53.E09.1.454.CMB.1.raw
  modified_base (519)..(519): a, c, t, g, unknown or other
  misc_feature (519)..(519): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctcccggcctccctgtctggtgctgtcggagacagactgaccatcacttgccgggcaagtcagaccgttgcgtctatttaaattggtatcagcagaaaccagggaacgccctcagctgctgctctatactgtatcttagtttccatcttggggtcccatcaaggttcagtggcagtggttcgtgggacagtatttcacttctctactatcagcagtctgctaaccgtgaagattgttgctaaacttactactgtacaacagtactacgacggacccctattccactttccgcccgtcggacctacacgtacgaactccgaagtaccgaacgtcgtcgcctacggcctacctnttaccg

SEQ ID NO: 262609 - DNA, 492 bp, Homo sapiens
  misc_feature: GYAE6OF02G905U.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtcccatcaaggttcagtggcagtggttctgggacagatttcactctcactatcagctagtctgccaacctgaagattgttgctaacttactactgtcaacagacttacaggcccattcactttcgcctggaccactaggtcaactccagcgaacgtgtggctgactacatccg

SEQ ID NO: 262610 - DNA, 553 bp, Homo sapiens
  misc_feature: GYAE6OF02HZ83H.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctgtcggagacagactgaccatcacttggccgggcaagtcagccgttcgcgtctatttaaattggtatcagcagaaaccaggaacgccctcagctgctgctctatactgtattctagtttccatcttggggtccctagtactaaggttcagtcggctagtggttcgtgggactagtatttcactctcactatcagcagtctcgacaacctgaagattgttacgctaacttactactcgtacaacagtacttacgacggtaccctattccgtactttccggaccccgttgggaccctacgtacgtacgaaacttacccgaacgtaccgaactcggtacgggccttacgcctacccgtattacccg

SEQ ID NO: 262611 - DNA, 565 bp, Homo sapiens
  misc_feature: GYAE6OF02IQM9M.35.53.E09.1.454.CMB.1.raw
  modified_base (272)..(272): a, c, t, g, unknown or other
  misc_feature (272)..(272): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccctccaccctgtctgcatctgtaggagaagcgtcaccatcacttgccggacagtcagagtatagtaattggttggcctggtatcagcagaaaccagggaacncccctaaactcctgattcttaaggcgtctactttagagagtggggtccatcaggttcagcggcagtggatcgtggacagacttcactctcaccatccaccacgcctgcagccttagattgtattttcgaccttaaaccttatttaccgtcgaccctaactagtattgggtacgtactttcccgtactacgtttccggcccttacgggaaacctaaggtggacttaactaccgaaaacgtaaccgttggtacggacgtcggacctaccgattaccgttggttccttctaacccg

SEQ ID NO: 262612 - DNA, 595 bp, Homo sapiens
  misc_feature: GYAE6OF02JPFGM.35.53.E09.1.454.CMB.1.raw
  modified_base (589)..(589): a, c, t, g, unknown or other
  misc_feature (589)..(589): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaatggtatcagacagaaaccgagggaaccgccctacagcgtcgctgctactatactgtatcttacgtttcctattccgttcggggttacctacgtacgtaaggttccgtaggtggcgtaggttcggtttcgtagggactagtactttacactctactactactcagacagtctagactaactgaactagttgttcgactaacttacctacttactacaaactagtaccttacgacggtaccctacttactaccgtttccgtaccgtccgggaccaccggtaacgtaccgtaaacctaccgaacgtaccgtaacgtacggtcggtacctacgtacctaccgtnttaccg

SEQ ID NO: 262613 - DNA, 533 bp, Homo sapiens
  misc_feature: GYAE6OF02IA3AT.35.53.E09.1.454.CMB.1.raw
  modified_base (274)..(274): a, c, t, g, unknown or other
  misc_feature (274)..(274): n is a, c, g, or t
  modified_base (363)..(363): a, c, t, g, unknown or other
  misc_feature (363)..(363): n is a, c, g, or t
  modified_base (527)..(527): a, c, t, g, unknown or other
  misc_feature (527)..(527): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttgcgtctatttaaattggtatcagcagaaaccagggaacncccctcagctgctgctctatactgtatcttagtttccattcgttgggtccatacaaggttcaggtggctagtggttcgtgggactagtnttcacttctcactatcagcagtctgacaacctgaagtatgttagactaacttactactgtacaacagtactacgacggtccctattccacgtttccgccgtcggacccacgtacggtacgaactaccgacgtacgtaacgttggtcggtacgtcgacctacctnttaccg

SEQ ID NO: 262614 - DNA, 523 bp, Homo sapiens
  misc_feature: GYAE6OF02JCJ2G.35.53.E09.1.454.CMB.1.raw
  modified_base (275)..(275): a, c, t, g, unknown or other
  misc_feature (275)..(275): n is a, c, g, or t
  modified_base (400)..(400): a, c, t, g, unknown or other
  misc_feature (400)..(400): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacncccctcagctgctgctctatactgtatctagtttccattcgttgggtccatcaaggttcagtggcagtggttctggggacagtatttcactctcacttatcagctagtctgactaacctgaagtnttgttagactaacttactactgtacaactagtacttacgacggtcccctattcctacctttcggccctgggaccacgacgtacgaactccgagacgtaactggtcggccttgcctaccattcg

SEQ ID NO: 262615 - DNA, 533 bp, Homo sapiens
  misc_feature: GYAE6OF02G5A89.35.53.E09.1.454.CMB.1.raw
  modified_base (281)..(281): a, c, t, g, unknown or other
  misc_feature (281)..(281): n is a, c, g, or t
  modified_base (396)..(396): a, c, t, g, unknown or other
  misc_feature (396)..(396): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccattctccggcctccctgtctggtgctgtcggagacagactgaccatcacttgccgggcaagtcagaccgttcgcgtctatttaaattggtatcagcagaaaccagggaacgcccctnagctgctgctctatactgtatctagtttccatcgttcgggtcccatcaagttcagtggctagtggttctgggacagtatttcactctctactatcagcagtctgcaacctgaagnttgttgactaacttactactcgtacaactagtaacttacacgggcccctaattcctaccgtttccggcccgtacgggaccaacgtacggtacgaactacccgagaccgtaacgtggtcggcctgcctacctattccg

SEQ ID NO: 262616 - DNA, 492 bp, Homo sapiens
  misc_feature: GYAE6OF02G5P8R.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtccatcaaggttcagtgcagtggttctgggacagatttcactctcactatcagcagtctgcaacctgaagatgttgactaacttactactagtacaacagtacttacacgggcccattcactttccgcctcggaccacagtcgaactccaagcgaagtcgtgctgacaccatc

SEQ ID NO: 262617 - DNA, 566 bp, Homo sapiens
  misc_feature: GYAE6OF02H3ZA3.35.53.E09.1.454.CMB.1.raw
  modified_base (562)..(562): a, c, t, g, unknown or other
  misc_feature (562)..(562): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctaatttaattggtatcagcaagaaaccagggaaccgcccctcagctgctgctctatactgtactcttacgttcctatcgttcgggtcctatacgtaaggttcagttcggctaggttggttcgtgggactagtatttcacttctactactatcaagtcagttctcgtaccaaccgtaggaacgtattcggtttacgactaaactttactactacgtacaactacgtaacgttacgacggccctattacctaccgtttccgccgtacggaccctacgtacggtactaactcaacgacgtaacgtgtcggacgtcgccaccgtnttcg

SEQ ID NO: 262618 - DNA, 528 bp, Homo sapiens
  misc_feature: GYAE6OF02I4F7S.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccagcctcctgtctgcatctgtcggagacagagtcaccatcacttgccggcaagtcagaccattcgctctaatttaaatggtatcgcagacggcaggacaacgcccctaactactgatgtatactgtactctattgactatattcgcgtccatcaagttcagtgcagtgatcgaggacagtatttcactcacaccatacaaacaatacaacaactgaatactttcgactaacttactactacgtaacaacagtaaccttacgaccggtaccctagttacctaccgtttccggacccttagggaaccctacgtacgtaccattaacctaccgtaacgacttggtacgctcgaccacgtac

SEQ ID NO: 262619 - DNA, 535 bp, Homo sapiens
  misc_feature: GYAE6OF02FFP9B.35.53.E09.1.454.CMB.1.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (529)..(529): a, c, t, g, unknown or other
  misc_feature (529)..(529): n is a, c, g, or t
tcagtacagatcgtcacgaccggtgctcgatttagagagagtgtgttgggtttgggggaggtcagtctcagtcaggacacagcatggacatgaggctccccgctcagctcctggggctcctgctactctggctccgaggtgccagatgtgacatccagatgacccagtctccggcctccctgtctggtgctgtcggagacagacctgaccatcacttgccgggnaagtcagaccgttcgcgttctatttaaattggtatcagcagaaaccagggaaccncccctnagctgctgctctatactgtactctagtttccattcgttgggtcccatcaaggttcagtggcagtggttcngggacagtatttcactctcactancagcagtctgaccaactgaagtnttgttgactaaccttactactgtacaacagtacttacgacggtcccctagttcctacgtttcggaccctagggaccacgagttccataccgtaccaacgtacctcggtcggcctcggacctaccgtnttaccg

SEQ ID NO: 262620 - DNA, 544 bp, Homo sapiens
  misc_feature: GYAE6OF02GVQXM.35.53.E09.1.454.CMB.1.raw
  modified_base (348)..(348): a, c, t, g, unknown or other
  misc_feature (348)..(348): n is a, c, g, or t
  modified_base (412)..(412): a, c, t, g, unknown or other
  misc_feature (412)..(412): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatctgggtccatcagttcagtgcagtggtctgggangtatttcactctcactatcagcagtctgcctaacctagaagtatgttcgactaacttactactntacaacacgtacttacgacggtacccctatttaccaccgtttcgcccgttagggacctacgtagtaccgaaacttacccacggtaaccgtaacgttacggtcgggtccgttacggcctaacccgtattaccg

SEQ ID NO: 262621 - DNA, 509 bp, Homo sapiens
  misc_feature: GYAE6OF02GGYX8.35.53.E09.1.454.CMB.1.raw
  modified_base (275)..(275): a, c, t, g, unknown or other
  misc_feature (275)..(275): n is a, c, g, or t
  modified_base (347)..(347): a, c, t, g, unknown or other
  misc_feature (347)..(347): n is a, c, g, or t
  modified_base (384)..(384): a, c, t, g, unknown or other
  misc_feature (384)..(384): n is a, c, g, or t
  modified_base (506)..(506): a, c, t, g, unknown or other
  misc_feature (506)..(506): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacncccctcagctgctgctctatactgtatctagtttccattcttgggtccatcaagttcagtgctagtggttcngggtacagtattcactctacactactcagctagtctnacaacctagaagtattgttgactaacttactatctacaacagtacttacgacggtcccatttcctacgttccgcccgtaggaccagacgtacgaactccagaccaacgtgtcggctcgcacntac

SEQ ID NO: 262622 - DNA, 530 bp, Homo sapiens
  misc_feature: GYAE6OF02HRVOA.35.53.E09.1.454.CMB.1.raw
  modified_base (222)..(222): a, c, t, g, unknown or other
  misc_feature (222)..(222): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggnaagtcagaccgttcgcgtctatttaaattggtatcagcagaaaccagggaacgcccctcagctgctgctctatactgtatctagtttccattcgttcgggtccatcaaggttcagtggcagtggttntgggacagntttcactctcactatcagcagtctgctaacctgaaagtnttgttagctaacttacgtactgtacaactagtacttacgacggaccctattcctactttccggtaccgtcggaccctacgtacgtcgtaaactccacgaccgtaacgttcgcggtctcggacaccgtattacg

SEQ ID NO: 262623 - DNA, 564 bp, Homo sapiens
  misc_feature: GYAE6OF02H4UAZ.35.53.E09.1.454.CMB.1.raw
  modified_base (223)..(223): a, c, t, g, unknown or other
  misc_feature (223)..(223): n is a, c, g, or t
  modified_base (278)..(278): a, c, t, g, unknown or other
  misc_feature (278)..(278): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttggccgggnaagtcagccgttgcgtctatttaattggtatcagcagaaaccaggaacgcccctnagctgctgctctatactgtatcttagttcctatcgttcgggtccatcgtaaggttcagtggctaggttggttcgtgggactagtatttcgacttctcacttatcagtcagtctcgctaacctggaatagttgttacgactaaccttactactcgtaactaaactacgtaaccttacgaccggtacccctagttccgtaccgtttccggcccgttacgggaccctacgacgttaacgaaactccgagaccgtaacgtcgtacgggtcctcggacctacgtattaccg

SEQ ID NO: 262624 - DNA, 629 bp, Homo sapiens
  misc_feature: GYAE6OF02ICAA3.35.53.E09.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctcctgtctggtgctgtcggagacagactgaccatcacttgccggcaagtcagaccgttcgcgtctatttaattggtatcagcagaaaccgaggaccnccctcagctgctgctntatactgtattctagtttccacgttcttcggggtccatctaaggttcgagtggctaggttcggttcgtcggggaactaggttactttaccacttccgtctaaccttatactaaaccgtagttctagtacctaaacgtggtaagtacgtttaggttacggtacctaaacgtttaacctacgttacgtaaccaactaacggttaaccttaacggtaacccgggtaccccttactttaccgttaaccgtttcccggacccgtttacggggaccctacgtacgtaccgaaacttccgagtacccgtaacgtcggtcggcgttacggacctaactactcgttaccg

SEQ ID NO: 262625 - DNA, 534 bp, Homo sapiens
  misc_feature: GYAE6OF02FUUG2.35.53.E09.1.454.CMB.1.raw
  modified_base (275)..(275): a, c, t, g, unknown or other
  misc_feature (275)..(275): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacncccctcagctgctgctctatactgtatctagttttccattcttggggtccctatcaaggttcagtggcaggtggttctgggacagtatttcactctcactatcagcagttctgccaacctgaagattgtgcaacttactactgtacaacagtacttacgacgggcccctagttctaccgtttccggcccttacgggaccctacgaacgtcgaaactcccgaaggaccgtaaccgttggtggacctggccaccattaccg

SEQ ID NO: 262626 - DNA, 585 bp, Homo sapiens
  misc_feature: GYAE6OF02I49FS.35.53.E09.1.454.CMB.1.raw
tcagtacagatcgtcacgaccggtgctcgatttagagagagtgtgttggggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctaatttaaatggtatcgcagaggccaggagaacgcccctaactactgatgtatactgtatcttactttgactatattcgccgtccatcaaggttcaggtgctaggtggatcgtgggacagtatttcactctacacctatacaaactaataactaacctaaacctagtaaacgtacttttagaaccttaaactttactacttacgtacaaactacgtaacttaccgacgggtacccctattacctaccgtttccggcccgtacgggaccctacgtacgtacctaagttacctaccgaaacgtaacgttgtacggcttacggaccacctacttccgttgttaccc

SEQ ID NO: 262627 - DNA, 535 bp, Homo sapiens
  misc_feature: GYAE6OF02HFKXF.35.53.E09.1.454.CMB.1.raw
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (393)..(393): a, c, t, g, unknown or other
  misc_feature (393)..(393): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctcctgtctggtgctgtcggagacagactgaccatcacttgccgggcaagtcagaccgttcgcgtctatttaaattggtatcagcagaaccagggaacnccctnagctgctgctctatactgtatctagtttccatcttgggtcccatctaaggttcagtggcagtggttctgggacagtatttcacttctcatatcagcagtctgacaacctgaagtnttgttcgacaactttactactgtacaacgtacgtacttacgacgggtccctagtttaccaccgtttccgcccgttacggacctacgtacgtaacgaactacgacgaccgtaacgtcggtacggactcggacaccgtattccg

SEQ ID NO: 262628 - DNA, 581 bp, Homo sapiens
  misc_feature: GYAE6OF02FH83I.35.53.E09.1.454.CMB.1.raw
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctattaaaattggtatnagcagaaaccagggaacgccccctnagctgctgctctatactgtatctagtttccattcttggggtcccatcaagttcagtggcagtggttctgggacagatttcactctcactancagcagtctgactaacctgaagtattgtagctaaacttactactgtacaaaccagtacttaaccgacgggacccctaagttcctaacgttttccggaccccgttacggggaccctaaccgtacgggttaaccgtaaaacgtaccccgtaacggaccgtaaaccgttacgggtacgggtaccctacggacccacccgtaatttacccgg

SEQ ID NO: 262629 - DNA, 644 bp, Homo sapiens
  misc_feature: GYAE6OF02GXWQK.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtccatcaagttcagtggctagtggttctgggactagatttcactctactactatcagtcagtctcgacctaaccgtgaaacgtattggttagtacctaaacgttacttaccttacgtactaacgtaagtaaccgttttaccgaaccggggtaccccctaagtttacccgttaacccgttttacccgggaccccgttacggggtaacccctaaccggtaaccggttaaccggtaaaaccgttacccgtaaacggtacccggtaaaaccggtttcggtaaccggggttacccgttacggtaccccgtaacccgtaacgtttccccgg

SEQ ID NO: 262630 - DNA, 537 bp, Homo sapiens
  misc_feature: GYAE6OF02F40MK.35.53.E09.1.454.CMB.1.raw
  modified_base (187)..(187): a, c, t, g, unknown or other
  misc_feature (187)..(187): n is a, c, g, or t
  modified_base (453)..(453): a, c, t, g, unknown or other
  misc_feature (453)..(453): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctcctgtctggtnctgtcggagacagactgaccatcacttgccgggcaagtcagaccgttcgcgttctatttaaattggtatcagcagaaaccagggaaccgcccctcagctgctgctctatactgtatctagtttccattcgttgggtccagtcaaggttcagtgactagtggttctaggggactagtacgttcacgtctcactatcagctagtctagactactagaagattgtcgactaacttactactcgtacaacagtactacgaccggtccctnttactccgttaccgcccgtggaccctacgacgttaccgaactacccaggtaccgtaacgttcgacggtctacgccactacttcg

SEQ ID NO: 262631 - DNA, 534 bp, Homo sapiens
  misc_feature: GYAE6OF02HK4HC.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcaagaaaccagggaacgcccctcagctgctgctctatactgtatctagtttccatcttggggtccatcaaggttcagtggctagtggttcgtgggacagtatttcgacttctacactatcagcagtctgcaacctgaagatgttcgctaacttactactcgtacaacacgtacttacgacggccctacttctaccgtttcggcccgtacgggacctacgacgtcggaaactccaaggaccgtaacgtggttcggacgttcgaccaccgtattccg

SEQ ID NO: 262632 - DNA, 576 bp, Homo sapiens
  misc_feature: GYAE6OF02FXGFF.35.53.E09.1.454.CMB.1.raw
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (573)..(573): a, c, t, g, unknown or other
  misc_feature (573)..(573): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccgaggtgccagatgtgacatccagatgacccagtctccggcctccctgtctggtgcttgtcggagacagactgaccatcacttcgccgggcaagtcacgtaccgtcgcgtacttatttaaattggtatcagacaacgaaaccgagggaaccgcccctcacgctcgcgtgtctctactactgtacttcttacgtttcctagtttccgttcgggtccctagttacgtaaggttcgtaggtggtacgtaggttggttcgtagggactagtactttcacctctactacttatcagctacgtctagacctactagaagtntgtntactaacttactctatacaactagtacctacgaccggtccctaattccgtaccgtttcggcccttacggacctacgacgtacgaactccgacgacgtaacgtgtcggactacgctacctntac

SEQ ID NO: 262633 - DNA, 565 bp, Homo sapiens
  misc_feature: GYAE6OF02FP302.35.53.E09.1.454.CMB.1.raw
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaaccgcccctnagctgctgctctatactgtactcttagtttccattcgttggggtccctagtctaaggttcagtggctaggttggtttcgtgggactagtatttcactctcactatcagcagtctgcaactgaagtattgttnactaacttactactgtactaacgagacctttacgaccgggtaccctattacctacgtttccggacccgttacgggacctacgtacggtaaccgtaaactcccgtaacgtaccgtaacgttcggtcggccgttacgaccctacctacttccg

SEQ ID NO: 262634 - DNA, 566 bp, Homo sapiens
  misc_feature: GYAE6OF02GXA3L.35.53.E09.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (431)..(431): a, c, t, g, unknown or other
  misc_feature (431)..(431): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctcctgtctggtgctggtcgganacagactgaccatcacttggccgggnaagtcagccgttcgctctatttaaatggtatcagcaagaaaccgaggaacgcccctanacgctgctgctcgtatactgtatctacgtttccattcgttggggtcccctatcgtaaggttccaggtcggacgtagttggttcgtaggggactagtatttccgacttcgtactacgtactcacgtctagtctacgacctaacctagaagngttcgttcgactacttactactgtactaacacgtacttaccgacggtccctattcctacgttaccgccgtcggaccacgtacgtacgaactacgacgtacgtaacgtcggtacggactcgacgacctagttaccg

SEQ ID NO: 262635 - DNA, 794 bp, Homo sapiens
  misc_feature: GYAE6OF02IQIN0.35.53.E09.1.454.CMB.1.raw
  modified_base (227)..(227): a, c, t, g, unknown or other
  misc_feature (227)..(227): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccgaggtcgccagatgtgacatccagatcgaccagtcctccggcctcctgtctggtgctgtcggagacagactgaccatctacgttggccgganaagtcaggtaccgttcgcgttacttaatttaaattggtatctagacaacgaaaccgacgggaaccctcccctacacgtctcgactcgtctactaactactagttacttacgtttacgtttacctacgttccggttaccgggtaccctaagttaccgttaaacgggttccgtaagggttacggtacgttagggtttcgggtttacggtaggggtaacctaaggtttaccttttaccgaaccgttttaccttactaaccttacgttaccgaacggtacttaacggttaccgtaccgtaacccgttaaaccggtaacgtaaaggttacgtttaggtttaaccgtaacccttaaaaccgttttaccgttaaccgtacgttaacccaaacgttaaccgttaaccgttaacccgtacccgggtaacccctttaacgtttaccccgttaaccgtttccccgggacccggttaaccggtaaccccgtaacgtaaccgggtaaaccgtaaaccgttccgaaacggtaaccgtaacggttcggtaccggtacctaccggaaccctccgtacttccgg

SEQ ID NO: 262636 - DNA, 527 bp, Homo sapiens
  misc_feature: GYAE6OF02FIZQM.35.53.E09.1.454.CMB.1.raw
  modified_base (222)..(222): a, c, t, g, unknown or other
  misc_feature (222)..(222): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggnaagtcagaccgttcgcgtctatttaaattggtatcagcagaaaccagggaaccgcccctcacgctgctgctctatactgtatctagtttccatcttgggtccatcagttcngtgcngtgtctggacngattcactctcactatcagcacgtctgcaacctagaagtattgtgactaacttactactcgtacaacgatacttacacgggtccctattcctacgtttccggccctacgggaccctacgacggtaacgaactaccgtacgtacgaacgttcggtcggtaccgtcgaccacctattccg

SEQ ID NO: 262637 - DNA, 816 bp, Homo sapiens
  misc_feature: GYAE6OF02J2LZA.35.53.E09.1.454.CMB.1.raw
  modified_base (190)..(190): a, c, t, g, unknown or other
  misc_feature (190)..(190): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtctccggcctcccgtgtctggtncgtggtcggagacagactgaccatcacgttcggcccggganaacgtccacggtacccgttcgccgttacttaaatttaacgttggtactcgagacaacgaaaccgacgggaacccnccccgtanagtcctagcctcggtaccttacgtactacgttcgtacgtttaccttacgtttccctagtttccgggttacgggaccccttaagtaccgtaacgggtttccgaggtcgggtaccttaagggtttcgggttaccgtaggggtaacctacggtttacgttttacccaccgttttcctaacctaaccgtttacgtccgtaaacggtccgtaaccggtttcctacgttaaccctaacggttaagtaaaacggttcgtttaccggtttacctaaaccgtttaaacctttaacccgttacgttaccgttaaacgaaaccgttaccgttaacccgtttaaaccggacccgggttaccctttaaccgtttcccggttaacccggttttcccggacccgggttacgggtacccaacggtaccggttaaacccgtaccggttaaccgaaccggtacggttaacccggtttcggtaaccggtcccgtaccggtacccttaccgtcctttaccgg

SEQ ID NO: 262638 - DNA, 640 bp, Homo sapiens
  misc_feature: GYAE6OF02JC3K8.35.53.E09.1.454.CMB.1.raw
  modified_base (197)..(197): a, c, t, g, unknown or other
  misc_feature (197)..(197): n is a, c, g, or t
  modified_base (401)..(401): a, c, t, g, unknown or other
  misc_feature (401)..(401): n is a, c, g, or t
tcagtacagatcgtcacgaccggtgctcgatttagagagagtgtgttgggtttgggggagtcagtctcagtcaggacacagcatggacatgaggctccccgctcagctcctgggctcctgctactctgggctccgaggtgccagatgtgacatccagatgacccagtctccggcctccctgtctggtgctgtcgganacagactgaccatcacgttggccggacaagtcacgtaccgttcgcgtcttaattaaattggtatctagacaacgaaaccgaaggaaccgcccctacagcgtgctgctactagtactagtatctagttcctagtcgttcgggtaccatacgtaagttctagtcggtcaggttcggtagtacgggtactaagtacttcactttacnctactactactagactagtcgtacgtacgaaacgtacgtaaatcgttaacggttagtaacttaaaccttacgtaacttacgtaaccgaataaccgtaacgtaaccgtaccggtaccctaacgttacctaccgtttaccggcccgttaccgggaccctaacgtacggtaaccgtaaacgaccgtaacggtaccgtaacggtacggtacggtaccgtaggtacccgtacctacgttacccg

SEQ ID NO: 262639 - DNA, 627 bp, Homo sapiens
  misc_feature: GYAE6OF02F2012.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcacgtaccgttcgcgtcttaatttaaacttggtatcgagtccaagaaaccgacgggaaccgcccctcagctgctcgctctatactgtatctattcatcgttcgggtcctatctaacggttcaggtggtacgtaggttcggttacgtgggactagtactttcgtactctacactactcagctagtctcgtacaacctaggtaagtacttggttactaccgttaaactttacctaactcgttaacctaaactacggttaaccgttaaccgtaaccggggtaccccttaagttaccgtacccgttttcccggacccgttacgggtacccacgtaaccgttaccgaaacgtcccgaacggtaacgtaccgtacggtcgtaccgtacgtaccgaccctagttcccg

SEQ ID NO: 262640 - DNA, 751 bp, Homo sapiens
  misc_feature: GYAE6OF02JBG6D.35.53.E09.1.454.CMB.1.raw
  modified_base (314)..(314): a, c, t, g, unknown or other
  misc_feature (314)..(314): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtcgccagatgtgacatccagatcgacccagtcctcccggcctccctgtctgggtcgcttggtacggagacagctcgaccatcacgttcggaccggacaacggtcaacggtaccggttcgcgttacttaactttaaattggttaacttacagtcaaggaaacccgaagggtaaaccnccccgtacgaacgcgtcgccgtgccttcgttaactaccgtagttacttacttacgttttaccaacgtttccggttcggggttaccctagtaccgtaacggttactaggtcgtacgtcggttggttcgagggtaccaggttatttacctaccgtcttacgtacttactaccgtaaggtctaacgttccggtactacgtaaccgttagtaaaggtacttacgggtttacacgttaaacctttaaccgtacgttaccggtaaacgaaaccgttaaacggttaaccgtttacccgggtaaacgggtaccccctatttaacccgtttacccgtttaccgggttcccgttaaccggtacccgttaacgtacggtaacccgtaaactcggtaaacccgacgtaacggtaacggtccggtactaccggactaccggtctttaccg

SEQ ID NO: 262641 - DNA, 665 bp, Homo sapiens
  misc_feature: GYAE6OF02IO1UT.35.53.E09.1.454.CMB.1.raw
tcagtacagatcgtcacgaccggtgctcgatttagagagagtgtgttggggtttgggggagtcagtctcagtcaggacacagcatggacatgaggctccccgctcagctcctggggctctgctactctggctccgaggtgccagatgtgacatccagatgacccagtctccggcctccctggtctggtgctgtcggagacagactgaccatctacttgccgggacaagtcagtaccgttcgcgttacttaagtttaaacttggtaactcacgtacaacgaaacccgagggaacctcccctacgagctgctgcctctatacgtgtactcttacgtttccagttcgttcggggtccctagtacgtaacggttcgagtcggactaggttcggttcgtagggactaggttactttccgacttctactacttactcagtactaggttcctagaccttaaccgtagaaagttgttacgttacgactttaaccttacgttacgtagtacctaacgtacgtaaccgttaacgaccgggtacccttagttacccgtaccgtttacccggaccgttacgggtacctaccgtaacggtaaccgtaaaccgtcccggtaacgtacccgggttaagttcggtaccggtacccttacggaacccgtaccttacgttccg

SEQ ID NO: 262642 - DNA, 649 bp, Homo sapiens
  misc_feature: GYAE6OF02HSGJ4.35.53.E09.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
tcagtacagatcgtcacgaccggtgctcgatttagagagagtgtgttggggtttgggggagtcagtctcagtcaggacacagcatggacatgaggctccccgctcagctcctggggctcctgctactctggctccggaggtgccagatgtgacatccaagatgacccagtcctccggcctcctgtctggtnctgtcgganacagactcgaccatctacttggccgggtacaaggtccaggtacccgttcggcgttcttaattttaaagttcggtaatcgaagtcaagtaaaccgagggaacccgcccctanacgtctcggctcggcttactattacgtgtactacgttacgtttccattccggttcggggtccctaattacgtaaggttcaggtcggactaggttcggttacgtgggactagtactttccaacgttcctactactactacgacgtcgtaacgtctacgacctaacgtgtaaagtcttgttacgacttaaacttaccgtatacggtaccaaacgtacgttacctacggaccggtaccctagtttaccctaccgttccggcctacgggacctaacggacgtaacgtaaccgtaccgacggtacctaaggttcggtacggtcctcgacctaccgtattccgg

SEQ ID NO: 262643 - DNA, 732 bp, Homo sapiens
  misc_feature: GYAE6OF02HZ0DQ.35.53.E09.1.454.CMB.1.raw
  modified_base (202)..(202): a, c, t, g, unknown or other
  misc_feature (202)..(202): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatcgaaatcgaccctagtctccttcccaccctgtctgcatcgtggtggganacagcgtcatcatctacttcgccgtggccagtcagacgtattagtgtacgttgggttcggtccttggtactcgagaccgaaacgtaaaaccgacggaaaccctaaaaacccctaactccgtagtatttaacgtaacggcctttacgttaagtttaacgaacgggttcgggtacccctaaggtaccgtaacgggttccggaccggagtacggtggtacttcggtagggaactagttactttccaaccgttcctaccacctactcacgtacccaacgtcgactacggtccgtaggtacgtaccgtttacgaaccttaacgtttacgttaacgtacgtaaacccgtaaatacgttaaactaacgtttaaccgtttacccttaccgtttaaccggttacgggaccgggtaacgggtaaacgtaacggtacgtaaaccgtaaccgtaaacgtacggttacggtaacggtctaaccggtacctaaccgttacttccggttaccgttacgttacccttaccgttccccttaccccgg

SEQ ID NO: 262644 - DNA, 1003 bp, Homo sapiens
  misc_feature: GYAE6OF02HUD6Z.35.53.E09.1.454.CMB.1.raw
  modified_base (193)..(193): a, c, t, g, unknown or other
  misc_feature (193)..(193): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactcgtggctccggaggtgccagatgtgacatccagatcgacccagtcctcccggcctccctgtctggtnctgtcggagacagactgaccatctacgttggccggacaagtcacgtaccggttcgcgtacttaattttaaagttggttaatcgtaacgacgtaaacggaaaacccgaacggggaaacccgtcccccgtacgaaccggccttacggtccgtacggtaccttacctttaaagttaacccgtttaggtttaaacctttaccgtttttaaacgttttttaccccgtaaacggtttttccccggtttttaccgggggggttacccccttaaaaccggtttaaccgtttaaaaccgggggtttttacccgtaaggggtttacggggtaaccgttaacggggtttttacgggggttttaaccggttacggggggtaaaccttaaacggggttttaactttttaacccgttaaaccccgttttaacctttaacccgttaaaccttttaaccgttaaccggtaaccggtaaccgttaacggtttaccgttaaccgttaaacccgtaaaacccgtttaaggtaaaaacggttagttttaacgggtttacgtaaacccgttaaaacccgttttaaacctttaaccgtttaaccgttaacctaaaaccggtaaacgtttaaaccgtttaaacccggtaacccgggtaccccctttaaactttccggttaaaccccgttttcccggggtaacccccgttaacgggggaaccccttaacgggaaacccgttaaccggtaaaaaccgttacccggaaacggttaacccggtaaaccgttcgggtaccggtaccgtaccggtaaccccaccgttactttaacccgg

SEQ ID NO: 262645 - DNA, 594 bp, Homo sapiens
  misc_feature: GYAE6OF02GYMVJ.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccagcctcctgtctgcatctgtcggagacagagtcaccatccacttggccgggcaagtcagacctattcgcgttacttaattttaaattggtactcgaccaggaggccaggacgaacgccccctaactactgatgtaatactgtatcttatttgactattattcggccgtacccagtcgtaaaggttcaggtcggcgtagtcggtattcgtagggaactagttactttcaccttctaccaacctataaccaaataataactaacctaaaccgtagaacgttactttacgaaccttaaactttactactgttaccaacgtacgtaccttacgacggtacccttattccgtaccgtttccggaccttacggacctacgtcgtacctaacgtactacccgaacgtactggtaccgctacgcctactcg

SEQ ID NO: 262646 - DNA, 692 bp, Homo sapiens
  misc_feature: GYAE6OF02GM4HV.35.53.E09.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcgganacagactgaccatcacttgccggcaagtcagaccgttcgcgtactatttaaattggtatcagcagaaaccgagggaaccncccctnagctgctgcctctatactgtactctagtttcacgttcgttcggggtcctacttacgtaacggttcgtaggtcggtacgtagttggttcgtagggactaggtactttctacttctactactactcgagcgtagtactcgacctaacctaggaacgtaagttcggttacaacgttaacccgtttaacttaccgttacggttaacaaaccgttaacggtaacccgtttaaccggtaacccgggtacccccttaacgttttaccgtaaaccccggttttacccgggacccgttacccggggtaaccctaaccggttacgtaacccggtaaaccgttaccccgtaacggtaacccggttaaacggttacggttccgggtaaccgtccggtaacccgtaccctaacgtttcccgg

SEQ ID NO: 262647 - DNA, 643 bp, Homo sapiens
  misc_feature: GYAE6OF02HRPO3.35.53.E09.1.454.CMB.1.raw
  modified_base (208)..(208): a, c, t, g, unknown or other
  misc_feature (208)..(208): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtcctccggcctccctgtcgtggtgctgtccggagacagacngaccatctacttggcccgggacaagtcgacgaccgttcgacgtacttaatttaaagtgtatcagactagaaaccgacggaccaccccgtcgacgcgtacgcgtcgtacctactactaacttcgtattacttacgtttacctacgttccgttcggggtaccctagtacgtaacggttcgaggtacggtcgtaggttaggttcgtagggacgtagtacgttactactccttacgtacctactacgaagacctagtccttagacctaaacgtacgtaatagttgtacgtacttaaacttctacgtactactaacgaacgtaccgtaacgtaccgacctaccttacgtaccgtccgtaccgtacgacctaacggacgtaacggtaacctccgtagtaccgtacgtacggcgtaccgtaccggtaacccacctacgtacg

SEQ ID NO: 262648 - DNA, 872 bp, Homo sapiens
  misc_feature: GYAE6OF02JB26C.35.53.E09.1.454.CMB.1.raw
  modified_base (202)..(202): a, c, t, g, unknown or other
  misc_feature (202)..(202): n is a, c, g, or t
  modified_base (867)..(867): a, c, t, g, unknown or other
  misc_feature (867)..(867): n is a, c, g, or t
tcagtacagatcgtcacgaccggtgctcgatttagagagagtgtgttgggtttgggggagtcagtctcagtcaggacacagcatggacatgacggctcccgctcagctccgtgggctcctgctactctggctccgaggtcgccagatgtgacatccagatcgacccagtcctccggcctcctgtctggtcgcgtggtcgganacagactcgaccatcctacgttcggcccggacaacggtccaacggtcccggtttcgaccggttacctttaaagtttttaaaagttgggttaacttaccgtaacgggtaccaaaacggtaaaaaccccggtaacgggggaaaaccccgtccccccttacggaaaccggtccgttacggcccttacggtccccttacgttaaactttacccgttaaggttaaccttttaccggtttaaccgtttttcccgtaacggttttaccgggtttcccgggggttaacccctaaacggtttaccggttaaaacggggtttcggtaacggttcgggttacggtaggtttcgggtttacggtacggggtacctaaggttacctttacggtacctttccgtactaacgttacttacgacgtaacttcgtacgtaaccgtaccgtaaacctaggaaagttcgtttaacggttaccgtaacctttaaaacctttaccttaacggtaccgtaaaccgtaaaccgttaccggtaacctttaaccgggaacccggttaccccttaacgtttccgttaaccggtttaccccgcggtttaacccgggaccttaacggtaccgtaaaccgtaaacctccggtaaacgccgtaagtcggtacgaccgttacggacttaaccggtnttccg

SEQ ID NO: 262649 - DNA, 600 bp, Homo sapiens
  misc_feature: GYAE6OF02J08JX.35.53.E09.1.454.CMB.1.raw
  modified_base (276)..(276): a, c, t, g, unknown or other
  misc_feature (276)..(276): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatcgacccagtctccggcctccctgtctggtgctgtcggagacagactgaccatcacttgccgggacaagtcagaccgttcgcgtctatttaatggtatcagcagaaaccagggaaccncccctacagctgctcgctctatactgtacttctagtttcctattcgttcgggtacctagtcgtaacggttcagtggacgtaggttggttcgtgggtaactaggttactttcacgtttcctactactactcacgtactacgtagtccgtaacctaacgtaggaactattaggttcgaacgtaacctttacgtacttaccgtacgtaacctagtaccgtaccgtaacccgggtcccctaatttcccgtaacgtttcccggacccgtacggaccacgtagtaccgtaactccgacgacgtactggtcgctaccgactccgattaccg

SEQ ID NO: 262650 - DNA, 603 bp, Homo sapiens
  misc_feature: GYAE6OF02F50QG.35.53.E09.1.454.CMB.1.raw
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (597)..(597): a, c, t, g, unknown or other
  misc_feature (597)..(597): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctggtcggagacagactgaccagtccacttcggccgggcaagtcacgaccgttcgcgtctatttaaattggtatcagcaacgaaaccgtagggaaccgccccctacacgcgtcgctgcctctatactgtactacttagtttcccattccgttcggggtccctaacgtcgtaacggtttcaggttcgacgtaggttcggttacgtagggtacagttactttccacttctactacttatccgagacgtatctcgtacctaaccgtagaacgtnttacgtnaccttaacttacctactacgtaacaaactcgaacgttaccgacgggtcccctattccaccgtttccgcccgtacggaccacgtacgtaacgaactacgccgtacgtacgtggtacgacgttcaccgtaccnttaccg

SEQ ID NO: 262651 - DNA, 634 bp, Homo sapiens
  misc_feature: GYAE6OF02IGXOZ.35.53.E09.1.454.CMB.1.raw
  modified_base (291)..(291): a, c, t, g, unknown or other
  misc_feature (291)..(291): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtcctccggcctccctgtctggtgctgtcggagacagactgaccatcacttcggccgggacaagtccagtacccgttcgcgttcttaattttaaattggtaattcagcaagaaaccgagggaaccncccctcagctgctgctctatctgtatcttagttctattcgttgggtcccatcgaagttcaggtggctaggttcggttacgtggggaactaggttactttcgtaccttccgtactaaccgttatccgtaagtaccgtacgttctaccggtacctaaaccgttaggtaaagttagtttacgttacgtacttaaaccgtttactacgttacgtacctaaactacgttacctaaccgacggtaccccttaatttcccgtacggtttccggacccgtacggacctacgtacgtaaccgaacgtccgaacgtaccgacgttggtaccgacgtccgtacaccgtattccg

SEQ ID NO: 262652 - DNA, 649 bp, Homo sapiens
  misc_feature: GYAE6OF02IYNS1.35.53.E09.1.454.CMB.1.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (326)..(326): a, c, t, g, unknown or other
  misc_feature (326)..(326): n is a, c, g, or t
  modified_base (395)..(395): a, c, t, g, unknown or other
  misc_feature (395)..(395): n is a, c, g, or t
  modified_base (478)..(478): a, c, t, g, unknown or other
  misc_feature (478)..(478): n is a, c, g, or t
  modified_base (528)..(528): a, c, t, g, unknown or other
  misc_feature (528)..(528): n is a, c, g, or t
  modified_base (644)..(644): a, c, t, g, unknown or other
  misc_feature (644)..(644): n is a, c, g, or t
tcagtacagatcgtcacgaccggtgctcgatttagagagagtgtgttgggtttgggggagtcagtctcagtcaggacacagcatggacatgaggctccccgctcagctcctgggctcctgctactctggctccgaggtgccagatgtgacatccagatcgacccagtccgtccggccctccctgtcctggtcgctagtcggagtacaggtactgacccgatctacgttcggcccgggnaacgtcacgtaccgttcncgtcttaagtttaaacttggtatacgtacgtacaacgaaaccgacgggaaccgtcccccacgacgcgtcncgtgcctccgtatactagtacttctaagtttccacgttcgttccgggtcctaagtaccgtaaggtttcngtacggtctaaggttcggttaccgttagggaaaccgtgtacgttttaccacttcctacgtactaacttacgagtctaacgttntacgaccaaaccgtgtaaaggtaacttgttacgactaacgttaccgtaanacggtacctaagacgtacgttaacgcggtacccttagtacctacgttccgtaccgtcgggacctacgtacggtaacgtaacctacgacgaccgtagacgttggcttacgcttaccncgtac

SEQ ID NO: 262653 - DNA, 861 bp, Homo sapiens
  misc_feature: GYAE6OF02HHFUH.35.53.E09.1.454.CMB.1.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
tcagtacagatcgtcacgaccggtgctcgatttagagagagtgtgttggggtttgggggagtcagtctcagtcaggacacagcatggacatggaggctccccgctcagcctccgtggggctcctgctactctggctccgaggtcgccagtatgtagactagtccagatcgaccctagtcctccctcccaccctgtctgcctatcgtggtgggaanacgagcgtcatacatctactcggcctgggaccagtcgacgactagttgngtacgttggtcgtctggtancgagacaacggaaacgacgaaaccctaaaacctactctagtaactttacgacgtaccttacgttaagttaaccgaagggttccggtaccaaggtaccgtagggtccggaggtactaagggtcggtagtaccggtaggtacgtaagtttacctttccgaccttaccgtaccttaaccgaccgttaaccgacgtaaccccgtaaaccgtggtaaccccgtagtacccgggttacggggttaacgtttaacccggtttaccgtaacccgttttaaaccgtttaccgtttacccgttaacgtaacccgttaaaaccgtttaaggtttaaacgtttaaacccggtttaaaccgttttacccccgtttttaaacccgggttttaaccggggttaaccgggggttaaacgggggtaaacccggtaaaaccgggtttaaacggggaaccgggtaaaaacccggtaaacccggtaaaccgggtttaaccgggttaaccggggttaccaacccggtttccgaaccccgtttaacggcttttacccggttaaccggtttacccttaccggtacccctttacccccggg

SEQ ID NO: 262654 - DNA, 624 bp, Homo sapiens
  misc_feature: GYAE6OF02JUZNW.35.53.E09.1.454.CMB.1.raw
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (419)..(419): a, c, t, g, unknown or other
  misc_feature (419)..(419): n is a, c, g, or t
  modified_base (484)..(484): a, c, t, g, unknown or other
  misc_feature (484)..(484): n is a, c, g, or t
  modified_base (527)..(527): a, c, t, g, unknown or other
  misc_feature (527)..(527): n is a, c, g, or t
tcagtacagatcgtcacgaccggtgctcgatttagagagagtgtgttgggtttggggtaggtcgagtcgtctagtcaggacacagcatggacatgaggctccccgctcagctcctcggggctcctgctactctggctccgaggtgccagntgtgacntccagatcgacccagtcctccggcctccctgtcctggtcgctggtaccgagaccngactgcctancactcggccggtnaacgtcaggaccttcgccgttnttaatttaacgttggtaactccggaccaggtaaccggccgtaaggacgtaaaccgcccccttaaaccgtagtcggaagttagtaacctacgtagtaactctttaacgttgactattcgttcgaccggtcctatacgtaacggttcagtccgggatacgggtntacttgtcggctaagtatttccgacttctcactacgtactaacgaattcaacctattagaacgtntttacgaatacgtttacactgtacaaccttaagcgttaaccgnggtaccccagttcctacggtttccaacccgtggactaccggtactccaattcccaacgcctaacgtgtccgtacgtcaccacgttacctgtacctcg

SEQ ID NO: 262655 - DNA, 793 bp, Homo sapiens
  misc_feature: GYAE6OF02HZVJI.35.53.E09.1.454.CMB.1.raw
tcagtacagatcgtcacgaccggtgctcgatttagagagagtgtgttggggtttgggggagtcagtctcagtcaggacacagcatggacatgaggctccccgctcagctcctggggctcctgctactctggcctccggaggtcgccgagatggtgacatccagatcgaccctagtccgtcccggcctcccgtgtcgtggtgcgtaggtcggaagacgagactacgaccactctacgttcggaccgggacaagtcgacgtacccgttcgtcgtattaacttttaaagtggtactcacggacgaaacgaaaccggaacgggtaacccaccccgtacacggtcgtcgacttcggtccttactaacgttactcgttacttaccgtttagtttaccctaagttcggttccgggtaacctacggttaacgtaacggttacgtagggtacggtacgttacggggttacgggttacgtggggtaaacctaggtttaccgttactaccgttcctaaccgtaacttacgtacgtacgtaccgtacgtacttacgtaaccgtaacccgtaggtaacttaggttacgttacgtaaacctacttaccgttaagtaccggttaacaaccggttaaacgtaaccgttaaccgtacccgggtaccttaacctttacccggttacccggttaacccggtacccgggttacgaacccgtaaccggttacggtaaacgtaaacccgtacggaaccggttaaccgtaacgttacggttaccggaccgttaccgacccttacccgtagttaccg

SEQ ID NO: 262656 - DNA, 783 bp, Homo sapiens
  misc_feature: GYAE6OF02F97ZP.35.53.E09.1.454.CMB.1.raw
tcagtacagatcgtcacgaccggtgctcgatttagagagagtgtgttggggtttgggggagtcagtctcagtcaggacacagcatggacatgaggctccccgctcagctccgtggggctcctgctactctggctccgaggtgccagatgtgacatccagatgacccagtctccggcctcctgtcttggtgctggtcggagacagaccgtgaacctatcctacgttcgggaccggggacaacggttccgaacggtcccgttcgaccgttactttaattttaaaagtttggttaactcaaggtacgaaacggaaacccggacggggaaacccgtccccctagacgtacctggccgttcggtaccttacgttaagttaccgtttaggttaactttacgttttacgttttaccttacggttcgggtttccgggtacccacttaacggtaacggttccgtaggttcggtacgtagggtttcgggttcggtacggggtaacgtaacggtttacctttacgtaaccctttcttaccgtaacttacgtaccgtacggtaacctcgttaccgtacgtaaccgtaaccgtaggaaccgttattcggttaacgtaaccgttacttaaccgtactacgtaaccgaaacttaccgttaaacgtaccgtacccggttacctactttacccgtaccggttccggtcccgtacggacccgacgtaacggtaaccttaacggacccgacggttacgaacgtttcggaccggtacgtacccgacgtaaccttagttacccg

SEQ ID NO: 262657 - DNA, 700 bp, Homo sapiens
  misc_feature: GYAE6OF02F3H37.35.53.E09.1.454.CMB.1.raw
  modified_base (99)..(99): a, c, t, g, unknown or other
  misc_feature (99)..(99): n is a, c, g, or t
  modified_base (136)..(136): a, c, t, g, unknown or other
  misc_feature (136)..(136): n is a, c, g, or t
  modified_base (548)..(548): a, c, t, g, unknown or other
  misc_feature (548)..(548): n is a, c, g, or t
  modified_base (688)..(688): a, c, t, g, unknown or other
  misc_feature (688)..(688): n is a, c, g, or t
tcagtacagatcgtcacgaccggtgctcgatttagagagagtgtgttgggttggggagtcagtctcagtcaggacacagcatggacatgaggctcccgntcagctcctggggctcctgctactctggctcgaggtnccagatgtcgactatccagtatcgacccagtctcccggcctaccgtgtctaggtcgctggtcggagacacgtaccgtcgaccagtcctacgttcggaccgggtactaaacggtcaacggtaccgttcggacttacttaatttaaagttcggtacttacgaaggtacctaacggtaaaaccggtacggggtaaccccgaccccgttacggaccgtacgtcggtacctcgtaccgttacgtacttaaccgttaggttacttaccgtttacgttttacccagtttaccggtacgggtacccctaagttaccgttaaacggttcgtacgtcggtacttaagggttcggtttacgagggtactacggtacttcgaccttctcgtactactcaacgtgaacttcgacacgtaacccgngtaaacgtgttcgtactaaccttaacttacgtaacgtaccgtaactaacggtaacgttaccgtaccgaccgtactacgttcctaacggttccgacgtacggacctagaacgtcaacttcgacgtatacgtcggcgtaccncgactcgtctcg

SEQ ID NO: 262658 - DNA, 658 bp, Homo sapiens
  misc_feature: GYAE6OF02GR0EC.35.53.E09.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
tcagtacagatcgtcacgaccggtgctcgatttagagagagtgtggttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagacgtgaccatcacttcggccgggctaagtcagaccgttcgcgtacttaatttaattggtatcagtcaagaaaccgagggaaccncccctnacgctgctgctctatactgtatctacgtttccagttcgttcgggtccatcgtaaggttcaggtgactagtcggttcgtagggactagtcgtttacacttccgtntaactatcacgtctagttcctcgaaccaaccgtaggaaacgttagttacggttacgtaccttaaacgtttaactacgttacgtaaccgtaacgtaacgtaaccgtttaaccgacccgggtaaccccttaacgttcccgttaaacccgtttcccgggtacccgtaccgggtaaccctaacgttaacgggttaaccctaaacgtcccgtaaggtacccgtaagttcggtccggtaccgtaccgaccctacccttacgtttccgg

SEQ ID NO: 262659 - DNA, 708 bp, Homo sapiens
  misc_feature: GYAE6OF02JVZXH.35.53.E09.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagtacagatcgtcacgaccggtgctcgatttagagagagtgtgttgggtttgggggagtcagtctcagtcaggacacagcatggacatgacgggtccccgctcagctccgtggggcctcctgctactcgtggctccggaggtgccaagtatggtgacatacgaaatcgacccagtcctcccttccgaccctgtctgctactcgtggtaggganaccagccgtcatcacgtactccgtgcccgtgaccgtgtccaaggtaacgtnttgtagtcgttaggttcggtaccgtaggtactcgaactacgaaacgaaaccgtaccggaaaaaccctaaaaccgtaccgtctaagttaattaacgtacgtctacgttaacgtaagtacggtccgtaacgacgtacggtacggtcggacgtagtacggcgtagttcggaacgtataacgttacttaacactcccgtacactacgacgaacctaacctacgtacgacacgtcctaagggttactttaacgtacgttaacccttaagttacctacgtaacaacccgtaataagttaaacctaaacggtttaaccttaaccggtaacccgtttacggaccgggtaacggtaccgtaaacgtaagaccggtaacccgaaacgtacgtacgtacggcttacggacgtacctacgtactcgttactccgttactacgtccctagtaccc

SEQ ID NO: 262660 - DNA, 573 bp, Homo sapiens
  misc_feature: GYAE6OF02I8J6I.35.53.E09.1.454.CMB.1.raw
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
  modified_base (546)..(546): a, c, t, g, unknown or other
  misc_feature (546)..(546): n is a, c, g, or t
tcagtacagatcgtcacgaccggtgctcgatttagagagagtgtgttgggtttgggggagtcagtctcagtcaggacacagcatggacatgaggctccccgctcagcctcctggggctcctgctactctggctccggaggtgccagatgtgaccatccagatcgaacccagtcctcccggccctccctgtccgtggtcnccgttggtcggagacgagactcgaccacttccacgttcggccggactaagtccgaacgtacccgttcgcgttnttaactttaaagtgtactcgccagacgccgaggacacgcccctaacctgngatagtatacttgtactcttattcgntattagtcgaccgtcctagtactaagttcgagtcggtgagtggtctacgtggaactagtactttcactcgacactataacaatataataccactagaactgttacactacttactactagtaccacgtactaccgtacgacgtccctnttactccgttcgcccgtacgaccnctactacagtccaacctacgtaacgngtaccgctcgtaccactcgtattcgtc

SEQ ID NO: 262661 - DNA, 808 bp, Homo sapiens
  misc_feature: GYAE6OF02F3ZEH.35.53.E09.1.454.CMB.1.raw
  modified_base (103)..(103): a, c, t, g, unknown or other
  misc_feature (103)..(103): n is a, c, g, or t
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (332)..(332): a, c, t, g, unknown or other
  misc_feature (332)..(332): n is a, c, g, or t
  modified_base (802)..(802): a, c, t, g, unknown or other
  misc_feature (802)..(802): n is a, c, g, or t
tcagtacagatcgtcacgaccggtgctcgatttagagagagtgtgttgggtttgggggagtcagtctcagtcaggacacagcatggacatgaggcctccccgntcagctcctggggctcctgctactctggcctcgaggtgccagatgtgacntccagatcgacccagtcctcccggccctcctgtctggtcncgtggtcggaanccgagacctgaacctatccacgttcggcccggactaaggtcgaaccggtaccgttccggcgttaccttaaagttttaaagttcggtaattaccgaacgacgaaacggtaaacccgacgggtaacccncccccttaagacgtaccgtcgtccgtacgtaccttactacttacgtttactacgttacgttacgtttccctacgtttaccggggttcccgggtacctaagttaaccggttaaaagggttccgaagggtttccggtacgttacgggtttacgggttaccggtaagggggtaacccttaaaggtttcctttaacccgaaccgttttccgtaacttaaccttacgtaacctacggtacgttacgttaccgtaaccgtaccgtaaaccgtaaggtaacgttacgttacgttaccgtaacctttaaaccttacgtaccgtacgtaaacgttaaccgtaacgtacctaacccggtaccgtacccgttaacttccgttaccggttcccggttcccgtaacggtacccgagttaaccggtaaccgtaaccgtcccgtaacgtaccgttagtacggcgaccgttacggaccctaccgtnttaccg

SEQ ID NO: 262662 - DNA, 753 bp, Homo sapiens
  misc_feature: GYAE6OF02H15TH.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagcctccgtggggctcctgctactctggctccgaggtgccagatgtgacatccagatcgacccagtcctccggcctccctgtctggcgtctggcggagacagactcgacctatctaccgtggacccggggacaacggtcacgtaccggttcgcgtacttaatttaaagttggtatcctagactaacgaaacccgagggaaccgccccctacggagtacctggtcctgtccgtacttaacttacgtgttaacttccgtttaactttcccgtaacgtttccggtttaccggggtacccctagttccggttaaacgggtttcctaacgggtggtaccgttagggttaccgggtttaccggtggggtaaaccttgttaaccgttaccgtacctttccttacctaacgttactacgacgtacgtacgttcgtcgtaaccgtaaacgtcggtaaacgtacgttcgtagtaaccctaactttaaccgtcgttaacgtcaaacgtaccgttaaccgttaccggaccggtacccttcttaccgtaccggttttacccgccgggtaccggtaccgtaacggtaccgtaacggttaacctaccggtaacgtaccgtaacgtcgggtacctacggtccgaaccttacccgtacttacccgg

SEQ ID NO: 262663 - DNA, 693 bp, Homo sapiens
  misc_feature: GYAE6OF02HLFKY.35.53.E09.1.454.CMB.1.raw
  modified_base (234)..(234): a, c, t, g, unknown or other
  misc_feature (234)..(234): n is a, c, g, or t
tcagtacagatcgtcacgaccggtgctcgatttagagagagtgtgttgggtttgggggagtcagtctcagtcaggacacagcatggacatgaggctccccgctcagctccgtggggctcctgctactctggctccgaggtgccagatgtgacatccagatcgacccagtcctccggcctccctgtcctggtcgctggtcggacgacagactcgaccatctacgttcggccgganaagtcaacgtccgtcgcgttcttaatttaaagttggtactcgacgacaacgaaaccgacgggaacccgtcccctagacgtctgtccttcgtaccttactacgtacttcgtacttacgttacgtttcctagtttccggttccgggtacccagttacctaaggttccgaggtcggtcgtacggttcgggttcggtacgggtacttacggttacctttaccaaccgtttccacgttactaacgtaccgagtactcgtacctacgaccctacgtaagtaacgtgtttacgaccgttacttaaacgtaccgttacgttctaacgaaccgtaacgttaccgttaaccgcccggtaccttaccgttaccgttcccggtttcccgtacccgtacggaccctacgtaccgtaaccgtaaccgtaccgacggtacgtacgtacggtcgaccgtccgacctactcttacg

SEQ ID NO: 262664 - DNA, 801 bp, Homo sapiens
  misc_feature: GYAE6OF02HUW6P.35.53.E09.1.454.CMB.1.raw
  modified_base (188)..(188): a, c, t, g, unknown or other
  misc_feature (188)..(188): n is a, c, g, or t
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtnctgtacggagacagactcgaccatcacgttgccgggacaacgtcgaacgaccgttcgacgtacttaacgtttaaagttggtattacaagcaaacgaaaaccgtaacggggaaaccgcccccgtaccgtaacgtacctcggaccgttacgccgttaccttaacgttaacgttacgtttaacgttaccgtttaacgtttttcccgtaacgttaccgtttaccggggggttacccctaaacgtaccgtaaaacgggttttaccgtaaggtcggtaccgttacggttacggggtttaacgtacgggggtaactaaccgggttaaactttccgtaacccgttcccttaccgtaaccctttaaacgtaccgtaacgtacctaacgtttccgtacggtaaccctaaaccgtaacgtaaacgttagtacgtttacggacgttaaaccttaacgtaacttacggtaacctaaagtaacgtaacgttaccggaacggtacccctaactttccgtacgtttaccggcccgttagggaccccgacgtaacgtacgtaaaccgttccgaaccgtacggaaccgttaggtaccggtacgttacggtaacccgtacctacgttacccg

SEQ ID NO: 262665 - DNA, 711 bp, Homo sapiens
  misc_feature: GYAE6OF02FYWPO.35.53.E09.1.454.CMB.1.raw
tcagtacagatcgtcacgaccggtgctcgatttagagagagtgtgttgggtttgggggagtcagtctcagtcaggacacagcatggacatgaggctccccgctcagctcctggggctcctgctactctggctccgaggtgccagatgtgacatccagatgacccagtctccggcctccctgtctggtgctgtcggagacagactgaccatctacttcgccgggcaagtcagtaccgttcgcgtcttaatttaattggtatcagcaacgaaaccgacgggaacctcccctacacgtctgtctcgcttactatacttgtacttcttacgtttccagttcggttcgggtccctagttacgtaacggttcgaggttggacgtaggtttcggttcgtacgggtaactaggttactttccgtaccttccgtactactataccgaagtccgtagttcctacgtacctaaacccgtaggtaaattagttacggttactaaccgttaacctttacctaacgttacgtaaccaaacgttacgttaaacccgttaccggtaacccgggtaccccttaacgtttacccgttacccggtttacccgggaccccgttaaccgggtacccgtaaaccgttaacggtaacccgtaaacctcccgtaaacggtacccgtaaaccggttggttaccggtacccgtagtaccccgtacctagtttacccg

SEQ ID NO: 262666 - DNA, 689 bp, Homo sapiens
  misc_feature: GYAE6OF02I91B8.35.53.E09.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
tcagtacagatcgtcacgaccggtgctcgatttagagagagtgtgttggggtttgggggagtcagtctcagtcaggacacagcatggacatggacggctccccgctcagctcctggggctcctgctactctggcctaccgaggtgccagatgtgacatccagatgaccctagtctccggcctcctgtctggtcnctgtacgganacagactgaccattcacttcggccggganaagtcagccgttcncgtctatttaaattggtactcgagtcagaaaccaggaacgccctacagcttgactgctacgtattactgttactacgtatttacccgatccgtttacggggtccctaagttccgtaaaggggttccaagggttcggtaccgttaggttacggggtttacgtagggggtaaccctaggtaactttacgaccgtttactactaaccgttaatacctagtcgaacgtcctacgactaaccgtacgaacgtattagtacgtactaacttacttaactacgtacctaaacgtagttaacctacgtaaccggtaaccctaaccttacgtaacccgttttacggacccgttccgggtaacccacgtaacggtaccggtaaaaccgttaaccgtaacgtaaccggtaacgttacgttacgggtaccttacgacggttaccaacgtttccg

SEQ ID NO: 262667 - DNA, 694 bp, Homo sapiens
  misc_feature: GYAE6OF02IE0BN.35.53.E09.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
tcagtacagatcgtcacgaccggtgctcgatttagagagagtgtgttgggtttgggggagtcagtctcagtcaggacacagcatggacatgacggctccccgctcagctcctggggctcctgctactctggctccgaggtcgccagatggtgacatccagatcgacccagtcctccggtcctcctgtctggtcgcgttggtacgganacgacgactcgaccactcctacgttcgggcccgganaacgtacgacggtacccgttgacgttacttaaattttaagttggtaatacgacgacgaaacggaaaccggacggaacccgtccctagacgctcgacttcgtactacgttctactgttacttacttacgttctacgttcggtcgggtacctagtaccgttaggtcgtggacggtcgtagttcgggtacgtacgggtaacctagtttaccgttccaaacgtttcctacctaacttcgtaaccgacggtttacaacgttcgtaaaccgaacgtaaccggtagtaaacgttcgtacggtttaacctacgttaaaccttcgtaacgtaccgtaactaaccgtacgtaacctaccggtaccggtaaccttcgttcgttaccggtccgacgtaccgacttagacgtacgtaacctcgaacggtacctcgttaaggcgtacctacggctacgtcttacg

SEQ ID NO: 262668 - DNA, 755 bp, Homo sapiens
  misc_feature: GYAE6OF02JQ9CF.35.53.E09.1.454.CMB.1.raw
  modified_base (142)..(142): a, c, t, g, unknown or other
  misc_feature (142)..(142): n is a, c, g, or t
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (438)..(438): a, c, t, g, unknown or other
  misc_feature (438)..(438): n is a, c, g, or t
  modified_base (480)..(480): a, c, t, g, unknown or other
  misc_feature (480)..(480): n is a, c, g, or t
tcagtacagatcgtcacgaccggtgctcgatttagagagagtgtgttgggtttggggagtcagtctcagtcaggacacagcatggacatgagctcccgctcagctccgtgggctcctgctactctcggacctccggaggtcnccaggtatgtagacactaccgagactacgacccgagttccgtccggtcccttcctcggttctgggtcgtacgtcggtaccggaacgactaacggactacgaccctacgtaccgtacgttccggccgggtaactaacgtccgacgtaccggtcgtcgtaccttaatttacggttgtacncgtacgacgaacgtaaacccggaggtacccgcccctatcgccgtgacgtcgtactcgtatacgtntacgttactacgtcctagtccggtaccggtcaacgttcgtacgtgtgtacggngtttacggtcgtacggtacggtaactagttcctacgttaccnccgttacaggtttacacgtacgtacgtaccgtacgtacaacctacgtaacgtaagttccgttaacgttccgaaaccgttaacgtcttaacggtacctaacgttaaacgacttaaacccggtaccgaacccggtcctttaaacgttccgttttaaaacccggccgtaccggttaacccgacgttaccgaaacgggttaaccgtaccctaacggttaaccctaacgggtccgtggtttaaccctaggaaccccggtacctcgtaaccccgttttagg

SEQ ID NO: 262669 - DNA, 787 bp, Homo sapiens
  misc_feature: GYAE6OF02F2XBE.35.53.E09.1.454.CMB.1.raw
tcagtacagatcgtcacgaccggtgctcgatttagagagagtgtgttggggtttgggggagtcagtctcagtcaggacacagcatggacatgaggctcccgctcagctcctggggctcctgctactctggctccgaggtgccagatgtgacatccagactgacccagtccgtcccggcctccctgtctggtcgtactcggtccggagtacgacggaccttgacccaattccgtaccgttcggaccggggtactaacgtcgaaacgccggtttccggtcggttacctttaattttaaaacggtttcgggtaacttaccgaaggtaccgtaaacggaaacccgaggggtaacccgtcccccttacgagtccgttgccttacggccttacgaacgttacttacggttacttacgtttaccgttttcctaacgttttccggttaccgggtaccaggtttaaccgtaagttcccgtaagggttcgtaccgtaggtttcgggttacgttacggggacctagttaccgtttacctactttactactacgttactacgtacggtaccgtagtacgttcgtaaccggaaacccttggtaagttacgttagttacccgtactttaactttacgtacctacgtaaccgtaacgtaacgtacgtacccgggtaccggttacccttagttacccggtactttaccgggacccgtcggtaccaccggttaccgtaacggtaaccctaccgagtaccggtaacttacggtcgggtcccctaggtacccgccttacggttccg

SEQ ID NO: 262670 - DNA, 739 bp, Homo sapiens
  misc_feature: GYAE6OF02GNMDR.35.53.E09.1.454.CMB.1.raw
  modified_base (127)..(127): a, c, t, g, unknown or other
  misc_feature (127)..(127): n is a, c, g, or t
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
tcagtacagatcgtcacgaccggtgctcgatttagagagagtgtgttgggtttggggagtcagtctcagtcaggacacagcatggacatgaggctcccgctcagctccgtgggctcctagctactcnggcctcgagtcgccagatgtgacatccaagngtacgacccagtctccagcctcccgtgttcncgctatccgtggcggtanacgtagtccgtacaatccacgttactaccgttcggacctcggacctacggtacgaacggtaccgttaagttacggtagtacgtacgggttcgaccgttagttacagacgtaacgaaacctaacgaggtaaaaccctaaaaaccttacgtcttaacgtatttaagaccgtaccttaagttaacgttaacgaaggttcgacctagacgtaacggtccggatcgtagtacgtntcgtagatacgtacgtacncgtacaccgtanaacgtcagtaccaactgaccgtagtacgtagtaacgtcgttaacaccggtttattaactcggaacgtaacccttaaaagtcgttaaacttaacccgttaaccgttacccggtaaacgttttaccggaaggaccggtaaaaccgggtaccgaaaagttaccggaaaccgtaaaccggtaaacgttagggtaacccgtaaggttcccgtaacggtacccggtacctttaaccgggttaccctttacggtttaacctacccgtttaaccccggg

SEQ ID NO: 262671 - DNA, 704 bp, Homo sapiens
  misc_feature: GYAE6OF02GZHP5.35.53.E09.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
tcagtacagatcgtcacgaccggtgctcgatttagagagagtgtgttgggtttggggggagtcagtctcagtcagggacacagcatggacatgaggctcccccgctcagctcctggggctcctgctactctggctccggaggtcgccagatgtgacatccagatcgaccctagtccgtcccggcctccctgtcgtggtcgcgtggtcggacgacgacgtacctacgacctatcctacgttcgggaccgggacaacgtacacggtaccgttccggcgttaacttaaagttttaacgttggttaatcgagtaccgaaacgtaaaaccgacgggaacccgcccctanacgtcngtctgccttctatacgtntacttcgtttaacttcctagttccggtccgggtctagtacgtagtntggtcgattaggtcggttacgtaggtacgtagttactttccactttctactaccttagtccagtaccgtacgttctaccgctaaaccgtagaacgtgttcgttacgaccttaacttaccgttacgtcgtaaccgtaacgtaacgtttacccgtacggtaacccggttcccctaacctttccgttacccggttacccgtacccggtcgtacccgttacgaaccggttccgtaaaccggccgtaaccgtacggttacgtcgggttcgccgtaccggaccttactacgttccg

SEQ ID NO: 262672 - DNA, 519 bp, Homo sapiens
  misc_feature: GYAE6OF01DDQEF.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtacaactatcgtacgagtggccgtccggggtccacgttcggcccgtgggaccgaggtggagatacgaaacgtatagtcggctgcaccatctgtctctac

SEQ ID NO: 262673 - DNA, 530 bp, Homo sapiens
  misc_feature: GYAE6OF01AINQ9.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcaggaccagtcagaatgttggcgccttcgtaagctggtaccaacacaaacctggccaggctccaggcccctcatctatggtgcatccaacagggccactggcatcccagccaggtcagtgcagtggtatgggacagacttcactctcaccatcatcagcctggacgcctagaagatgttgctagtttattactgtacaactatacgtacgagtcggccgtccgggggtcctacgtttccggcccgtcgggacctagggtggacgagtacgaaacgtactggtcggctgaccacactctgtcttcac

SEQ ID NO: 262674 - DNA, 525 bp, Homo sapiens
  misc_feature: GYAE6OF01C6Y42.8.33.C11.1.454.CMB.1.raw
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (514)..(514): a, c, t, g, unknown or other
  misc_feature (514)..(514): n is a, c, g, or t
tcagctcgcgtgtccacgaccggtgctcgatttagagtgagctcgttgggtttgggggaggaactgctcagttaggacccaggagggaaccatggaagccccagctcagcttctcttcctcctgctactctggctccagtttcagataccaccgganagattgtgttgacacagtctccagccacctgtctttgtctccaggggaaangccaccctctcctgcagggccagtcagaatgttggcgaccttcgtaagctggtaaccaacacaaacctggccaggctccaggcccctnatctatggtnacatccaacgagggccactcggcatcccagccaggttcagtgcagtgggatgggacagacttcactctcacatcatcagcctggacgcctagaagatgttgactagtttattactgtactaactatccgtacgagtcggtccgtcggggtcctacgttcggccgtgggaccgtaggtggagatacgaacgtactggtgctgctacatntcgtcttcgtc

SEQ ID NO: 262675 - DNA, 557 bp, Homo sapiens
  misc_feature: GYAE6OF01DJFRU.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagaatgttggcgccttcgaagctggtaccaacacaaacctggccaggcctccacggcccctcatctatggtgcatccaacgacgggccacgtggcactcccagccaggttcagtgcaggtgggtatgggacagacttcactctcaccatcatcacgcctggacgcctagaagatgttgactagtttattacgtgtacaactatccgtacgagtcggcccgtccggggtcctacgtttccggcccgtgggaccgtaagggtggacgtagtacgaaacgtaacgtggtcgacgtgacctacctatctcgttccttcgtaccg

SEQ ID NO: 262676 - DNA, 520 bp, Homo sapiens
  misc_feature: GYAE6OF01C2FSN.8.33.C11.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (512)..(512): a, c, t, g, unknown or other
  misc_feature (512)..(512): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttgtaagctggtaccaacacaaacctggccaggctccaggccccctnatctatggtgcatccaacgagggccatggcatcccagccaggttcagtggcaggtgggtatgggacagacttcactctcaccatcatcacgcctggacgcctagaagtattagtgctagtttactactgtacagctagtatgttaccgtcccgtggtacgttcgacgaagggaccaggtgacaatcgaaccgtatgtcggctgcactatctgttctntattcccg

SEQ ID NO: 262677 - DNA, 527 bp, Homo sapiens
  misc_feature: GYAE6OF01BKVFD.8.33.C11.1.454.CMB.1.raw
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgtaagctggtaccaacacaaacctggccaggctcccaggcccctcatctatggtgcatccaacagggccactggcatcccagccaggttcagtgcaggtggtatgggacagacttcactctcaccatcatcagcctggagcctgaacgatgttgctagtttattactgtacaactatcgtacgngtcggtcccgtccggggtcctacgtttccggcccgtcgggaccgaggtcggagagtacgaacgagtggtcgctgcaccatctcgtctctacg

SEQ ID NO: 262678 - DNA, 583 bp, Homo sapiens
  misc_feature: GYAE6OF01DEV8Q.8.33.C11.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccaggggaaaangccaccctctcctgcagggccagtcagatgttgcgcttgaagctggtaccaacacaaacctggccaggctccaggcccctnatctatggtgcatccaacgagggccacgtggcatcccagccaggttcagtggcagtgggtatgggacagacttcactctcacatcatcagcctggacgcctagaagatgttgcgtagtttattactcgtacaactacgtcgtaccgaggtcgggtcccggtcccgggggtcctaccgtttccggacccgttcgggaaccgtaacgggtacggaacgtacgtaccgaaaaccggtaacgttcggtacgggccgtacggaccgtacctaacgttccgttacgttcgttcctaccg

SEQ ID NO: 262679 - DNA, 684 bp, Homo sapiens
  misc_feature: GYAE6OF01BL3SN.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagaatgttggcgccttgtaagctggtaccaacacaaacctggccaggcctcccaggcccctcatctatggtgcatccaacgacgggccactggcatcccagccaggttcagtggcaggtgggtatgggacagacttcacctcaccactactacactacgaccgtccggtaggaccgtacgtaaggaaacgttgttcggttacgtacgttttaagttttacgttacgttacgtaacctaaacgttaccggttacccggtaacggtacgggtacccgggtccccgggggtacccggggttaccctttcccgggttcccggtacccggggtaccgggaaaccgggtaggggtacgggtaacgtaaccggtaaaccggtaaaccggttacggttcgggtcgtaccgtcgaaccctacgttacgttacgttccgtttaccttcgttaccccg

SEQ ID NO: 262680 - DNA, 513 bp, Homo sapiens
  misc_feature: GYAE6OF01BD94S.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgttggcgccttgtaagctggtaccaacacaaacctggccaggctccaggcccctcatctatggtgcatccaacagggccactggcatcccagccaggttcagtggcagtgggtatgggacagacttcactctcaccatcatcagcctgagcctgaagatgttgctagtttattactgtcaacatcgtacgagtcggcctccggggcctacgtttcggcccgtgggaccaggtcggagatacgaaacgaactgtcggctgcacatctgtctctac

SEQ ID NO: 262681 - DNA, 527 bp, Homo sapiens
  misc_feature: GYAE6OF01ER1IH.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgtaagctggtaccaacacaaacctggccaggctcccaggccccctcatctatggtgcatccaacagggccactggcatcccagccaggttcagtggcagtgggtatgggacagacttcactctcaccatcatcacgcctggagcctagaagatgttgctagtttattactgtacaactatcgtacgagtcggccgtccgggggtcctacgtttccggcccgtcgggaccaagtcggatagtacgaaacgtatgtggctgacaccatctgtctctac

SEQ ID NO: 262682 - DNA, 622 bp, Homo sapiens
  misc_feature: GYAE6OF01EJHQ9.8.33.C11.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccacctctcctgcaggccagtcagatgtgcncttgtagctgtaccaacacaaacctggccaggctccaggcccctnatctatggtgcatccaacgagggcccacgtggcactcccagccaggttcaggtcggcaggtgggtatgggacagacttcactctcaccatcatcagcctggacgcctagaagattgttgactagtttattacgtagtactaactacgttaccgtaccggtaggttcgggacccggttcccggggggtacccttaccggttttcccgggaccccggttacggggtaacccgtaacggggttcgggaaacgtacgttaaccggaaaaccggtaacggttacgggtcgggacgttacggaccctaaccgtacgttaccgttcgttccgttcgttacccg

SEQ ID NO: 262683 - DNA, 520 bp, Homo sapiens
  misc_feature: GYAE6OF01C0ZQI.8.33.C11.1.454.CMB.1.raw
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaaagagccaccctctcctgcagggccagtcagaatgtgcgccttcgaagctggtaaccaacacaaacctggccaggctcccaggcccctcatctatggtgcatccaaacgacgggccactggcactcccagccaggttcagtgcagtgggtatgggacagacttcactctcacntcatcagctganctagaagatgttncttagtttatactgtacaactatccgtacgagtcggcccgtcggggcctacgttcgccgtgggaccaaggtcgagtanacgaaacgatggngcagcacatctcgtnttctaccg

SEQ ID NO: 262684 - DNA, 534 bp, Homo sapiens
  misc_feature: GYAE6OF01DWS6R.8.33.C11.1.454.CMB.1.raw
  modified_base (295)..(295): a, c, t, g, unknown or other
  misc_feature (295)..(295): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgcttcgtagctggtaccaacacaaacctggccaggctccaggcccctnatctatggtgcatccaacagggccactggcatcccagccaggttcagtggcaggtgggtatgggacagacttcactctcaccatcatcagcctgggacgccgtgaggtaattggttgctagttttattactgtacaactatccgtacgagtcggccgtcccgggggcctacgtttcggcccgtggaaccaagtcggatagtacgaaacgagtgtggctgcctacatcttcgtcttctac

SEQ ID NO: 262685 - DNA, 557 bp, Homo sapiens
  misc_feature: GYAE6OF01ETNCI.8.33.C11.1.454.CMB.1.raw
  modified_base (454)..(454): a, c, t, g, unknown or other
  misc_feature (454)..(454): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
tcagctcgcgtgtccacgaccggtgctcgatttagagtgagctcgttgggtttgggggaggaactgctcagttaggacccaggagggaaccatggaagccccagctcagcttctcttcctcctgctactctggcctcccagtttcagataccaccggagagattgtgttgacacaatctcagccaccctgtcttcgtctccgaggggaaagacgcccaccctctcctacgagggccagtcagaatggttggcgcctacgtatcctggtaaccaacacgaaacctggccaggcctcccacggcccctcactctagtggtgcactccaacgacgggcccaacgtcggcactcccacgccgtaggttccaggtggcgaggtgggtagtggggacaggacttcactctcacatcatcacgctggacgctgagagtgtgctagtttatactgtacaacntacgtacgagtcggccgtccgggcctacgttccggcccgtaggaccgaagtgactactacgaaacgtacgtaggtcgcgcgacacctatctntcttncttccg

SEQ ID NO: 262686 - DNA, 557 bp, Homo sapiens
  misc_feature: GYAE6OF01EPQ32.8.33.C11.1.454.CMB.1.raw
  modified_base (444)..(444): a, c, t, g, unknown or other
  misc_feature (444)..(444): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccaggcccctcatctatggtgcactccaacgagggccacgtggccatccccagccgaggtcagtggcaggtgggtatggggacaggacttcactctcaccatcatcagcctggagcgtgaagatgttgctagtttattactgtactaactatcgtacgngtcggccgtccggggtcctacgtttccggcccgtacgggaccgaagggtcggagacgtaccgaaacggtaactcggtcggcgtgacctaccgactacgtcgttcttcgtaccg

SEQ ID NO: 262687 - DNA, 573 bp, Homo sapiens
  misc_feature: GYAE6OF01BRLNA.8.33.C11.1.454.CMB.1.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcncttgaagctggtaccaacacaaacctggccaggctcccaggcccctnatctatggtgcatccaacagggccactggcactcccagccaggttcagtggcaggtgggtatgggacagtacttcactctacaccatcaatcagcctggacgcctgaagtatgttgctagtttattactgtacaactatacgtacgagtcggtccgtccggggtcctaccgtttccggcccgtacgggaaccgtaagggtacggacgtagtaccgtaaacggtaacgtacggtcggccgtaggacctaaccgtactaccgttcgttccgttcgtaccg

SEQ ID NO: 262688 - DNA, 675 bp, Homo sapiens
  misc_feature: GYAE6OF01CPA8N.8.33.C11.1.454.CMB.1.raw
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagcctgggaggtcacagagactctcctgtgcagcctcgtgggttccaccttcagtagctacggcatcgcacgtcgggtcccgaccaaaaccgtccgaggcgaagggtatttgggaggtggggtggactaggtttgtttaccagttcgtaggacgggctaggttcgttacaaagttggtatgcgtgaccggtccggtaggaacgggtccgtacttccacctacgtcctaccaagaacgaacaaaccgtaccgaacggaaaccaacgtaagtacgttagtttacggaacctacgaacgaacgtaccgttaacgtccgtaggtacggaaccgtacgggtacgtaacgttactaacgtacggtaacgggaaaggggacgggggaaaccacgggtacggggtaacgttaccgaacggttaccgttaccgtttaggaccggttcggtacggggtacccgg

SEQ ID NO: 262689 - DNA, 596 bp, Homo sapiens
  misc_feature: GYAE6OF01CUTQW.8.33.C11.1.454.CMB.1.raw
  modified_base (324)..(324): a, c, t, g, unknown or other
  misc_feature (324)..(324): n is a, c, g, or t
  modified_base (375)..(375): a, c, t, g, unknown or other
  misc_feature (375)..(375): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccacggagagattgtgttgacacagtctccagccaccctgtctttgtctccgaaggggaaagacgccctaccctctcctgcagggccagtcagaatgttggcgccttcgtaagctaggtaaccaaacacaaaaccgtggaccaaggcctcccgaggccccctacatcctaatgggtnctacaccaaagcgggaccaactggcaactccccagccgaggttcaggtcgnaggtgggatgggacagacttcactcacaccatcatcagcctggagcctagaagtatgttgacttagtttatacngtacaactagtacgacgngtacggcccgtaccggggtcctacgtttccggacccgtagggaaccgaagggtgaacgtactaaccggaaacgaacgttggttcgggacctcggtaaccaccgtaacttcgtcgttcttaccgtacccg

SEQ ID NO: 262690 - DNA, 599 bp, Homo sapiens
  misc_feature: GYAE6OF01DA4FI.8.33.C11.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (379)..(379): a, c, t, g, unknown or other
  misc_feature (379)..(379): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaaanagccaccctctcctgcagggccagtcagaatgttggcgccttcgtaagctggtaccaacacaaacctggccaggcctcccaggcccctnatctatggtgcatccaacacgggccactggcactcccagccaggttcagtggcaggtgggtatgggacagacttcacttcncacatcatcacgcctggacgccgtagaacgtattggttgtactagttttacttactgtactaactactaccgtaccgaggttcggcccggtcccgggggtcctaccgtttccggcccgtcgggaacccgtaagggtcggaacgtacgtaccgaaaaccggtaacgttcggtgggaccgttcgacctaacccgtacttccgttcgttccctttcgtacccg

SEQ ID NO: 262691 - DNA, 522 bp, Homo sapiens
  misc_feature: GYAE6OF01AWMXX.8.33.C11.1.454.CMB.1.raw
  modified_base (211)..(211): a, c, t, g, unknown or other
  misc_feature (211)..(211): n is a, c, g, or t
  modified_base (399)..(399): a, c, t, g, unknown or other
  misc_feature (399)..(399): n is a, c, g, or t
  modified_base (515)..(515): a, c, t, g, unknown or other
  misc_feature (515)..(515): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngcccaccctctcctgcagggccagtcagaatgttggcgccttcgtaagctggtaccaacacaaacctggccaggcctcccaggcccctcatctatggtgcatccaacgagggccactggcatccccagccaggttcagtggcaggtgggtatgggacagacttcactctcacatcatcagcctggacnccgtgaatatgttgctagtttattactgtcaactatcgtacgagtcggccgtccggggacctcgttcggcctgggaccgaggtcggagacgtacgaacgatggtgctgcacatctntctctac

SEQ ID NO: 262692 - DNA, 586 bp, Homo sapiens
  misc_feature: GYAE6OF01DL1HO.8.33.C11.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagacgccaccctctcctgcagggccagtcagagtgttaccaccctagttacgcctaggtaacccaacaccaaacctggaccaggcctcccgaggcccctnatccttgatgcatccatcaggccactggcactcccagcctaggtcagtgcaggtgggctgggacagacttcactctacaccatcagccagcctagacgcctagaagttatttgacttagtttacttactcgtacaactagtacgtaccgtagtcggccgtccggggcctaccgtttccggacccgtacgggtaacctaaagttcggaagtacgtaaccgaaaacgtacgtgtacggccttcgaccaccgtatccgttagtccttacgcgttaccccg

SEQ ID NO: 262693 - DNA, 530 bp, Homo sapiens
  misc_feature: GYAE6OF01DBIOC.8.33.C11.1.454.CMB.1.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcncttcgtaagctggtaccaacacaaacctggccaggcctccaggcccctnatctatggtgcatccaacagggccactggcatcccagccaggttcaggtggcaggtgggtatgggacnggacttcactctcaccatcaatcagcctggacgctagaagatgtgactagttttactacttgtacaactagtcgtacgagtcggcccgtccggggtctaccgttcggccgtgggaccgaggtgacgatacgaaacgactggtcgcgtgactacatctcgtctctacg

SEQ ID NO: 262694 - DNA, 624 bp, Homo sapiens
  misc_feature: GYAE6OF01CL8Y6.8.33.C11.1.454.CMB.1.raw
  modified_base (210)..(210): a, c, t, g, unknown or other
  misc_feature (210)..(210): n is a, c, g, or t
  modified_base (424)..(424): a, c, t, g, unknown or other
  misc_feature (424)..(424): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcgtccttgaagctggtaccaacacaaacctggccaggcctcccaggcccctcatctatggtgcactccaaacgacgggcccaacgtcggccactccccagcccgtaggttcaggtggcgaggttcggggtatagggacaggtacttcgactctacaccatcatcacgtcctagggacnccgtagaacgtattgttgcttaagttttactacgtagtacaactacgtaccgtacgacggtcggtcccggttccgggggtacccttacggtttcccgggcccgtagggaaccgtaaggggtcggaagacgtacgaaaacggtaacgttcggtacggccgtgaccctaccgttaacttccgttacggttccttcgtacccg

SEQ ID NO: 262695 - DNA, 542 bp, Homo sapiens
  misc_feature: GYAE6OF01EU641.8.33.C11.1.454.CMB.1.raw
  modified_base (209)..(209): a, c, t, g, unknown or other
  misc_feature (209)..(209): n is a, c, g, or t
  modified_base (537)..(537): a, c, t, g, unknown or other
  misc_feature (537)..(537): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgttaccaccagttagcctggtaccaacacaaacctggccaggctcccaggcccctcatcttgatgcatccatcagggccactggcatcccagccaggttcagtggcaggtgggtctgggacagtacttcactctcaccatcagcagcctagagcctagaagtatttgctagtttattactgtacaactatacgtacgtaggtcggtccgtcccgggggtcctaccgtttccggcccgtcgggacctaaagttgagtactacgaaacgtaactgtacggctcgcacctatctgtcttcncttcc

SEQ ID NO: 262696 - DNA, 540 bp, Homo sapiens
  misc_feature: GYAE6OF01CYOUG.8.33.C11.1.454.CMB.1.raw
  modified_base (274)..(274): a, c, t, g, unknown or other
  misc_feature (274)..(274): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaaactccaggcaagggattggagtgggtggcagttgtttcatctgagggcagtgttcaatggtatgctgacgccgtgaagggccgattcaccatctccagagacaactccaggaacacaatgtattggacctgaacagctaagtccngaggacacgggtgtatactactgtaacgaagggaggggaaccaggcggattccaagtacctcttgacgtcgtgggccgagggtaccctggtcctaccgtcctcctcacgtcctccgaacacgggcccagtccgtcctcccctggccnccctgcctcgagcncacctcgagacncacgacgccgccctgggctcggccctggtaccaacggctacgtccgacaccgngacgctggacgngggctggacgaggccgcganagcngngn

SEQ ID NO: 262697 - DNA, 616 bp, Homo sapiens
  misc_feature: GYAE6OF01B33RY.8.33.C11.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanagcccaccctctcctgcagggccagtcagaatgttggcnccttgtaagctggtaccaacacaaacctggccaggcctcccaggccccctcactctatggtcgcatcccaacgacgggcccacgtggcactccccagccaggttcaggtggcaggtgggtatgggacagacttcactctcaccatcatcacgcctaggacgcctaggaagtatgttgtacgttagttttacttacgtagtacctaactattaccgtacggtacggtccgggtcccggtcccgggggtacccttaccggtttcccggtcccggtacgggaacccgtaagggtagggacgaacgtaccgaaaaccggtacgtcggtcggctacggacctaccgtacttccgttcgttccttcgtaccg

SEQ ID NO: 262698 - DNA, 538 bp, Homo sapiens
  misc_feature: GYAE6OF01CUBWU.8.33.C11.1.454.CMB.1.raw
  modified_base (210)..(210): a, c, t, g, unknown or other
  misc_feature (210)..(210): n is a, c, g, or t
  modified_base (526)..(526): a, c, t, g, unknown or other
  misc_feature (526)..(526): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagaatgttggcgccttcgtaagctggtaccaacacaaacctggccaggctcccaggcccctcatctatggtgcatccaacgacgggcccacgtcggcactccccagccaggttcagtggcagtgggtatgggacagacttcactctcacatcatcacgcctggacgcgtagaagtatgttgctagtttattactgtactaactatcgtacgagtcggccgtccggggtcctacgttccgcccgtggaccgaggtggagtacgtacgaaacgtatggtcgcgtgctacactntcgtcttctacg

SEQ ID NO: 262699 - DNA, 566 bp, Homo sapiens
  misc_feature: GYAE6OF01C0OAN.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgaagctggtaaccaacacaaacctggccaggcctacccaggccccctcatctatggtgcatccatccgagggccacgtggcatccccagccaggttcaggtggcaggtgggtctgggacagaccttcactctcacatcagcagcctagacgctagaagttatttcgctaagttttacttactgtaccaactactaccgtacgacggtcggcccgtccgggggtcctacgtttccggccctagggaacctaaagttgaagtacgtaacgaaacgtactggtcggctagacctacctacttctcgttcttctaccg

SEQ ID NO: 262700 - DNA, 691 bp, Homo sapiens
  misc_feature: GYAE6OF01B5SVI.8.33.C11.1.454.CMB.1.raw
  modified_base (207)..(207): a, c, t, g, unknown or other
  misc_feature (207)..(207): n is a, c, g, or t
  modified_base (394)..(394): a, c, t, g, unknown or other
  misc_feature (394)..(394): n is a, c, g, or t
  modified_base (525)..(525): a, c, t, g, unknown or other
  misc_feature (525)..(525): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccacggagagattgtgttgacacagtctcagccaccctgtctttgtctccgaggggaaanacgccaccctctcccgcgacggacggctacgtacgaagtagttggttcggccgttccgttaacggtacgtcggttaaccgaaaccaacaaaccgtaacggccggacgaccggtccctacccggacccgtccctatactacgtagtcggcactaccaaccgaacggaccggacctcgacgactacccnccgacgcgttacgtagcggtacgagtagggttaggtaggtacggttacttcgtactaccgttccacctaactactaaacaaccttacgcaactactcgtacgtactttcgttagtactttaagtttctcgngacagctagtacgaagacgtcggtccgttaccttcgttacgggtcgggaacgggtaacgtaaccggtaggtacccaacgtaaaccgaaacggttcggtggggaccttaggacccacctaacttcgtttcgttccgtttactaccggttccttcccccggtccgtta

SEQ ID NO: 262701 - DNA, 657 bp, Homo sapiens
  misc_feature: GYAE6OF01DGIZJ.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgtccttcgtaagctggtaccaacacaaacctggccaggcctcccaggcccctcatctatggtgcataccaacgacgggcccaacgtggcatccccagccaggttcagtggcaggtgggtatgggacagacttcactctacaccatcatcacgccgtgggacgtcccgtagaagtagttggttagtacgttaagttttaacttacgttagtactaaaccgtacttaccggttaacccgtaaggttccgggaccccggttcccggggggtaccttacccgggtttcccgggaccccggttacggggaacccggtaagggtacgggacgtaacgtaaccgtaaaaccggtaagttacggttcgggacctcggacctaacccgtacgttacttcggttacttccgttaacccg

SEQ ID NO: 262702 - DNA, 557 bp, Homo sapiens
  misc_feature: GYAE6OF01CGFWW.8.33.C11.1.454.CMB.1.raw
  modified_base (386)..(386): a, c, t, g, unknown or other
  misc_feature (386)..(386): n is a, c, g, or t
  modified_base (517)..(517): a, c, t, g, unknown or other
  misc_feature (517)..(517): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
tcagctcgcgtgtccacgaccggtgctcgatttagagtgagctcgttgggtttgggctgaactgggttttcctcgttgctcttttaagaggtgtccagtgtcaagtgcaactggtggagtctggggggaggcgtagtccagcctgggaggtcacagagactctcctgtgcagcctctgggttcaccttcagtagctacggcatgcactgggtcccgccaaaactccagggcaagggattgggagtgggtggcagtttgttcatcgtgagggcagtgttcaatggtatgctgacgccgtgaacgggccgattcaccatctccagagacaactccagaacacaatgtatttggacctgaacagacctaagtcctagaggacacgggtntatactactagtaacggaagggaggggaaccaggacgggagttaccaagttactcgttgacgtcgtgggccagggtaccctggtccacgtctcctcacgtcctccacgacggcccagtccgtcctccccgngcccgccctgcctccgaggcnccncctcgagcncncgcgg

SEQ ID NO: 262703 - DNA, 600 bp, Homo sapiens
  misc_feature: GYAE6OF01EHO0E.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcnccttgaagctggtaccaacacaaacctggccaggctcccaggcccctcatctatggtcgcatccaacgagggccacgtggcactcccagccgaggttcaggtcggcaggtgggtatgggacaggacttcactctcacctatcatcacgtcctggacgccgtagaagtagtgttgacgttaagttttattactcgtactaactacgttaccgtaccgaggttccggcccggtcccgggggtcccttaccggtttccgggcccgtacgggaccgtaagggtcggaacggtacgtaccgaaacgtaacgtcgggtcggtccgtacggacctacctacgttcttcgttccgttctaccg

SEQ ID NO: 262704 - DNA, 524 bp, Homo sapiens
  misc_feature: GYAE6OF01CZSUJ.8.33.C11.1.454.CMB.1.raw
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgttgcgcttcgagctgtaccacacaacctgccagctccaggcccctnatctatggtgcatccaacgagggcccacgtggcactcccagccaggttcagtggcaggtgggtatgggacagacttcactctcacatcatcacgcctggacgcctagaagatgttgtctagtttattactgtacaactatacgtacgagtcggcccgtccggggtcctacgttccggccgtcgggaccgtaaggtggagactacgaaacgagtggtcggcgtgcacatctcgtctctac

SEQ ID NO: 262705 - DNA, 538 bp, Homo sapiens
  misc_feature: GYAE6OF01BT3AA.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (397)..(397): a, c, t, g, unknown or other
  misc_feature (397)..(397): n is a, c, g, or t
  modified_base (512)..(512): a, c, t, g, unknown or other
  misc_feature (512)..(512): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttcgtaagctggtaccaacacaaacctggccaggctcccaggcccctnatctatggtgcatccaacagggccactggcactcccagccaggttcagtggcaggtgggtatggggacagacttcactctcaccatcatcagcctggacncctagaacgatgttgctagtttattactgttacaactataccgtacgagtcggccgtccggggcctaccgtttcggcccgtagggaccgaggtggacgatacgaaacgtatcggnggctgacctaccatctcgtcttctac

SEQ ID NO: 262706 - DNA, 612 bp, Homo sapiens
  misc_feature: GYAE6OF01CE5LD.8.33.C11.1.454.CMB.1.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgaagctggtaccaacacaaacctggccaggctccaggcccctnatctatggtgcatccaacagggccactggcatcccagccaggttcagtggcaggtgggtatgggacagacttcactctcaccatcatcagccctgggactccgtagaagtagttgttacgacgttaagttttaattacgtacgtaacctaaacgtacgttaccggtaaccgtaagggtccggtaccccgggtcccgggggtacccttaccggtttcccgggtcccggtacgggaaccgtaagggtggaacgtacgtaaccgtaaaacggtactgggtcgacgttcgaccgtactacttacgtcgttccttcgtacccg

SEQ ID NO: 262707 - DNA, 550 bp, Homo sapiens
  misc_feature: GYAE6OF01CL1IS.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcaggaccagtcagaatgttggcncttcgtaagctggtaccaacacaaacctggccaggctccaggcccctcatctatggtgcatccaacacgggccactggcactcccagccaggttcagtgcaggtgggtatgggacngacttcactctacacatcatcagcctggacgcctagaacgtattggttgacgttagtttaattactgtacaactatcgtaccgagtcggcccgttccggggtcctacgtttcggcccgtgggaccaagggtcgaagactacgaaacgtacgtggtacgcgtagcctaccgtatctgtcgttctaccg

SEQ ID NO: 262708 - DNA, 532 bp, Homo sapiens
  misc_feature: GYAE6OF01B0U6R.8.33.C11.1.454.CMB.1.raw
  modified_base (461)..(461): a, c, t, g, unknown or other
  misc_feature (461)..(461): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcacgtgggtccgccaaactccaggcaagggattggagtgggtgctagttgtttcatctgagggcagtgttcaatggtatgctgacgcgtgaagggccgatcacatctcagagacactccagaacacaatgtattgacctagaacacgacctaagtcctaggacggacgtacgggtntatactacgtgtaacggaagggacgggggaaccaggcgggagtccgaagtctacgttgcgtcgtgggtccg

SEQ ID NO: 262709 - DNA, 700 bp, Homo sapiens
  misc_feature: GYAE6OF01AO13K.8.33.C11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccaccctctcctgcagggccagtcagatgttggcnccttgagctggtaccaacacaaacctggccaggcctcccgacggccccctcactctagtggtcgccactaccaacgacgggccacgtcggccactcccgagccgtaggttcaggtcggcgtaggtgggtacgtggggacacggtactttcgactccgtaccaacctataccactccgacgtccgtggacgtcccgtagtaagtagttcggttcgtacgttaagttttacgttaccgttggtaacctaacgtacgttacccgggttaacggtacggttccgggtacccccgggttacccgggggtaccccttaaccgggtttttcccgggaccccggttacggggaacccgtaaggggttcggaaccgtacgtaaccggtaaaccggttaacggtcgggttacggaccttacggaccgtaacccgttataccggttcgttaccctttcgtacccg

SEQ ID NO: 262710 - DNA, 548 bp, Homo sapiens
  misc_feature: GYAE6OF01C3N07.8.33.C11.1.454.CMB.1.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccaggggaaagngccaccctctcctgcagggccagtcagaatgttggcgccttgtaagctggtaccaacacaaacctggccaggctccaggcccctnatctatcgggtnctactccaacgagggcctaacgtcggcactccccagcccaaggttcagtggcaggtgggtatgggacagacttcactctacaccatcatcagcctggancctagagattgtgactatttattactgtacaactatcgtacgagtcggtccgtccgggggtcctacgtttcggcccgtgggaccgaagggtggacgactacgaaacggacttggtcggcgtggacaccattctgtcttcgtac

SEQ ID NO: 262711 - DNA, 896 bp, Homo sapiens
  misc_feature: GYAE6OF01CWL8E.8.33.C11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcnccttgtaagctggtaccaacacaaaccgtggccaggcctacccaggcccctnatcctatggtcgacactccaaacgacggggcccaacgtcggaccaacgttcccccgaggccccgtaagggtttccaagggtttcgggaccgtaaggggtttacgggggttaaacgttcggggggaaacctaacgggtaacccttttaccaacccgtttacccgttacccgaaaccccttaagttaccctaacgtttacccgaacggtccccggttacggggtaaccgtaccccggttaaggtaaacgggtaaagtttcgggttttacggtaaccgtttaaagggtttttaaacttttaaccgttacggtttaaccctaaaaccgttaacgtttacccgggttaacccggttaacgggttacccgggggttacccccgggtttaccccggggggggtacccctttaaccccggggttttaccccgggtaccccccggggtttacgggggaaaccccggttaaacgggggttaccggggtaaaccgggttaaccgttaaaccggtaaaaaacccgggttacggttacgggttacggtacccgttacggtaccctaacccgttaacgttccgtttacgtcccgttttccgttaaccccg

SEQ ID NO: 262712 - DNA, 561 bp, Homo sapiens
  misc_feature: GYAE6OF01BTJON.8.33.C11.1.454.CMB.1.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (476)..(476): a, c, t, g, unknown or other
  misc_feature (476)..(476): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagcctctgggttcaccttcagtagctacggcatgcactgggtccnccaaactccaggcaagggnttgggagtgggtggctaggttgttcatctggagggctaggtgttcaagtggtatggctggacgccgtggaacgggccgtattccacctatctaccagacgacaactccgagaacacaatgtattcggactagaacagacctaagtcctagacggacacgggtntatactacgtagtacggaagggacggggaaccagggcgggtacgtaccgaagtaccttaccgttagaccgttggtcgggtaccgg

SEQ ID NO: 262713 - DNA, 589 bp, Homo sapiens
  misc_feature: GYAE6OF01D92U8.8.33.C11.1.454.CMB.1.raw
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctanggtgcatccaacngggccactggcatcccagccaggttcagtggcaggtgggtatgggacagacttcactctcacctatcatcagtcctaggacgcctagaagagttgttgctagttttacttactgtacaactacgtccgtaccgagtcggtacccggtccgggggtacccttacggtttcccggcccggttacgggaaccgtaagggtacggacgtaacgtaaccgtaaaacggtaacgttgggtcggacgtcgaccgtaccacgttcgtcgttcgttctacccg

SEQ ID NO: 262714 - DNA, 686 bp, Homo sapiens
  misc_feature: GYAE6OF01AK07D.8.33.C11.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaancgccaccctctcctgcagggccagtcagatgtggcncttgtagctggtaccaacacaacctggccaggcctcccacggccccctcatcctagtggtcgcactaccaacgacgggcccacgtcggaccactccccgagcccgtaggttccaggtcggcgtagggtgggtagngggacaggtacttcactctacaccatcactcacgtccgtaggacnccgtagaacgtnttcgttgtacttagttttactacgtgtactaacgtacgttccgtacggtcggtaccgggtcccggttaccgggggtaccccgttaccggtttcccgggtaccccggtacggggtaacccggtaacggggttacgggtaacggtaacgttaaccggtaaaaccgggtaacggttaccgggtcgggtacccggtacggaaccccgtaccgttacgtttacccgttccgtttccgtttaccgtaaccccg

SEQ ID NO: 262715 - DNA, 559 bp, Homo sapiens
  misc_feature: GYAE6OF01C4GTZ.8.33.C11.1.454.CMB.1.raw
  modified_base (211)..(211): a, c, t, g, unknown or other
  misc_feature (211)..(211): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngcccaccctctcctgcagggccagtcagaatgttggcgtccttcgtaagctggtaaccaacacaaacctggccaggcctcccaggcccctcatctatggtcgcactccaacgacgggcccaactggcactcccagccaggttcagtggcaggtgggtatgggacaggacttcactctcaccatcatcacgccgtggacgcctagaacgtagtgttgtactagttttattacgtgtacaactactacgtacgtagtcggcccgttccgggggcctcgttccggcccgtcgggaccgaggtggacgatacgaaacgtactggtcggctgccacatcgtcgtcttctaccg

SEQ ID NO: 262716 - DNA, 661 bp, Homo sapiens
  misc_feature: GYAE6OF01DKA8F.8.33.C11.1.454.CMB.1.raw
  modified_base (300)..(300): a, c, t, g, unknown or other
  misc_feature (300)..(300): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgccaccctctcctgcagggccagtcagaatgttggcgccttcgtaagctggtaccaacacaaacctggccaggcctcccacggcccctnatctatggtcgcactccaaacgcgggacccacgtggccactccccgagccaggttcaggtgcgaggtgggatgggacagaccttnactctacaccatcatcacgcctggacnccgtagaagtagttgttgacttagttttaacttactagtacctaaacgtacttaccggtaccggtaaggtccgggtcccggttcccggggggtacccttaaccggttttcccggggaccccgttacggggtaacccgtaaaggggttaccgggaaacggtaacgtaacccggtaaaaccggtaacggttagggtcgggtacctacggaccctaacccgtaagttcccttcggttcccttccgtaacccg

SEQ ID NO: 262717 - DNA, 572 bp, Homo sapiens
  misc_feature: GYAE6OF01BWWA3.8.33.C11.1.454.CMB.1.raw
  modified_base (209)..(209): a, c, t, g, unknown or other
  misc_feature (209)..(209): n is a, c, g, or t
  modified_base (440)..(440): a, c, t, g, unknown or other
  misc_feature (440)..(440): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttgtaagctaggtaccaacacaaacctggccaggcctcccacggccccctcatctatggtgcatccaacgagggccacgtggcatcccagccaggttcagtggcgaggtgggtatgggacagacttcactctcaccatcatcagcctggacgcctagaagattggttgactagttttatactagtacaactntacgtacgtagtcggcccgttcccgggggcctacgtttccggcccgttaggggaacccgaagggttcggagtaacgtacgaaacggtacgtggtcggacgtcgacctacctagtcctagttcccttgtaccg

SEQ ID NO: 262718 - DNA, 640 bp, Homo sapiens
  misc_feature: GYAE6OF01COYAM.8.33.C11.1.454.CMB.1.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (404)..(404): a, c, t, g, unknown or other
  misc_feature (404)..(404): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtcttgtctcgaggggaaagcgccaccctctcctagcagggccagtcagatgtgcnctgagcngtacanacaacngcagcnccagcctnatctatggtncatccaacncgggaccagtcggcactccagccaggtcagttgctaggtgggtatcgggaactagtacttacactctaccactatacatacacgtccgtaggacgaccgttagaacggtnttacggttgtaacttagttttaacttcgtagttacctaaacgttacgttacggtacccgggtagttccggggtccccggttacccgggggtacccttaaccgggtttcccgggacccggttacgggggaaacccggttagggttacggaacggtaacttaacccggaaacggtaacggttacggcggtacgtacgtacgaacccttacttcggttacgttccttaacggttacccc

SEQ ID NO: 262719 - DNA, 623 bp, Homo sapiens
  misc_feature: GYAE6OF01CO1FG.8.33.C11.1.454.CMB.1.raw
  modified_base (210)..(210): a, c, t, g, unknown or other
  misc_feature (210)..(210): n is a, c, g, or t
  modified_base (314)..(314): a, c, t, g, unknown or other
  misc_feature (314)..(314): n is a, c, g, or t
  modified_base (571)..(571): a, c, t, g, unknown or other
  misc_feature (571)..(571): n is a, c, g, or t
  modified_base (587)..(587): a, c, t, g, unknown or other
  misc_feature (587)..(587): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
tcagctcgcgtgtccacgaccggtgctcgatttagagtgagctcggttggggtttggggaggaactgctcagttaggacccagagggaaccatggaagccccagctcagcttctcttcctcctgctactctggctccagtttcagataccaccggagagattgtgttgacacagtctccagcccacctgtctttgctccgaggggaaaancgccaccctctcctgcacgggcagtcagaatgttggcgccttgtaagctaggtaccaaacacaaactggaccaggctacccaggcccctcatccgtagtcggtnacaactacccaaagacgggaccacgtcggaccacgtccccgaagccgtaagggtttcaggtaggaccgaaggggttggggtaattacgggggaactacggtaacctttcgaacttcctaccaacataccatccgaacggtccgtagggacgaccttaaggaagtaagttggttacgacgttaagttttaactttaccgagtactaaactagtaccgtacggaagtcgggaccggtccggggcctaccgttcgaccgnggaccgaggtgacganacgaaacganggngcngccacatcncgtntcgtacc

SEQ ID NO: 262720 - DNA, 536 bp, Homo sapiens
  misc_feature: GYAE6OF01A9KGH.8.33.C11.1.454.CMB.1.raw
  modified_base (207)..(207): a, c, t, g, unknown or other
  misc_feature (207)..(207): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagaatgttggcgccttgaagctggtaccaacacaaacctggccaggctcccaggccccctcatctatggtgcatccaacagggccactggcatcccagccaggttcagtggcagtgggtatgggacagacttcgactctcaccatcatcagcctggacgcctagaagtatgttgctagtttattacgtntacaactatcgtacgngtcgcccgtccggggccctacgtttccggcccgtgggaccgaagggtcggagatacgaaacgacgtaggtcggctgccaccgattactgtcctgtacc

SEQ ID NO: 262721 - DNA, 773 bp, Homo sapiens
  misc_feature: GYAE6OF01DM5LP.8.33.C11.1.454.CMB.1.raw
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagatttgtgttgacacagtctccagccaccctgtctttgtctccgaggggaaangcccaccctctcctgcagggccagtcagaatgttggcgccttgaagctggtaaccaacaacaaacctggccaggctcccaggcccctnatctatggtgcataccaacgacgggccacgtggaccactaccccagaccgtaggtttccaaggttcgggaccgtaaggttgggggtaacttaggggggaaacctaacgggtacctttaccaacctttcccgtaccaaccctaacgttaccaacgttaccgaacggtccccgttacgggacgtacccggtaaggaaaggtacgttcggtttacggtaccgttaaggtttttaacttaccgttacggttaacctaaactacgttaccggtaacccggtaagggttccgggtaccccggttcccggggggtacccttaaccggttttccccggggaccccggttacgggggtaacccgtaaacggggttacggaacgggtaacgttaaccggaaaaccgggttaaccgtagggttccgggacgttacggaacccgtaccttaacgttccggttttacgttccgtttccgttaacccg

SEQ ID NO: 262722 - DNA, 652 bp, Homo sapiens
  misc_feature: GYAE6OF01ESTEE.8.33.C11.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgctccgaaggggaaancgcccaccctctcctgcagggccagtcagatgtggcncttganctgtacaacacaaccnggcagctccacgcccctnatctatggtcgcactacccgaacgacgggccacgtcggacactccccagccgtaggttcaggtggctagggtgggtagtgggacaggtaccttcgacctctacactatcacgtcacgtccgtaggacgtacgtagaacgtgttagttacgtactttagtttaactcgttacgtactaacgtacgttaccggtacggtacggtccggtccccggggtacccgggtaccgttaccgggtttcccgggacccggttaccgggaaccggtaagggtacggacgtaacggtaaccgaaaaccggttgtacgggtccggtaccgtacggaccctaccgttacgttaccgtcggttaccttccgtaccccg

SEQ ID NO: 262723 - DNA, 548 bp, Homo sapiens
  misc_feature: GYAE6OF01B5EX3.8.33.C11.1.454.CMB.1.raw
  modified_base (209)..(209): a, c, t, g, unknown or other
  misc_feature (209)..(209): n is a, c, g, or t
  modified_base (394)..(394): a, c, t, g, unknown or other
  misc_feature (394)..(394): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcaggaccagtcagaatgttggcgtccttcgtaagctggtaccaacacaaacctggccaggctcccaggcccctcatctatggtgcatccaacacgggccactcggcatcccagccaggttcagtggcagtggtatgggacagactcactctcaccatcatcagcctggacnctgaagtgtgttgactagtttattacgtgtacaactatcgtacgagtcggccgtccggggtcctaccgtttcggcccgtcgggaaccgtaggtcggacgtacgtacgaaacgtacgtaggtcggacgtgacctaccgactctcgtcttctaccg

SEQ ID NO: 262724 - DNA, 656 bp, Homo sapiens
  misc_feature: GYAE6OF01BE3VS.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaaacctggccaggcctcccaggccccctcatctatggtgcatccaacgcgggtccacgtggcactccccagccaggttcaggtggcaggtgggtatgggacagtacttcactctacaccatcactcagccgtgggacgtccgtagaagtacgttgttcgacgttaggttttaattaccttagtacctaaacgtacgttaccggtaaccggtaggttcccggggtaccccggtacccggggggtccccttaaccggttttccccgggaccccggttaccggggaacccgtaaggggtacggtaaggaactaccggaaaaccggtaacgtcgggttcggaccgttcggtacccaccgtacgttaccgttcgttccgttacgtacccg

SEQ ID NO: 262725 - DNA, 709 bp, Homo sapiens
  misc_feature: GYAE6OF01DYBJA.8.33.C11.1.454.CMB.1.raw
  modified_base (223)..(223): a, c, t, g, unknown or other
  misc_feature (223)..(223): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (700)..(700): a, c, t, g, unknown or other
  misc_feature (700)..(700): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtcctccagccaccctgtctttcgtctccgaggggaacacgcccacctcncctgcagggccagtcagtaatggtcgcgtcgttacgaagctacggtaccaaacacaacccgtggaccacggcctacccgaccggtccctcactactttcggtggacncaacctaccgaacgccggaccacgngaccacgtcccgaggtccgtagggttcgaggtacgacggtagggtacgggtacgacggtacgtactactccgtacctacctaccactaactacgaactccgaacggtcctaacggggtctaacccggttaagtaaacgttcgttagttacggtaacttttaacgtttacgttaaccgacgttaccaaaccggttacggtacccggtaacgggttccggtaccggggtccccggtacccggggttaccaccgggtttccggaacccggtaagggaacgtagggtaacgacgaaaccgtacgtacggagttcgcggtaccacgacctacgttcttaccgtcttaccncgttacccg

SEQ ID NO: 262726 - DNA, 645 bp, Homo sapiens
  misc_feature: GYAE6OF01D33XC.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgttgcncttganctgtacanacaactgcagctccagcccctnatctatggtgcatccaacgngggccacgtggcatcccagccaggttcaggtggcgaggtgggtatgggacagtacttcactctcaacatacatccgagccgtgggacnccgtagaaagtnttgttcgacttagttttacttacgtgttaactaaaacgttccgtaaccggtaggttaccgggtcccggttaccccggggggtacccttaccggttttcccgggaccccggtttaggggaccccgtaaagggggttcgggaaacgtacgtaaccggtaaaaccggtaacggttagggtcgggaccgttcgggtacccaaaccgtcgtttacccgttacgttccctttccgtaaccgtttcccccg

SEQ ID NO: 262727 - DNA, 659 bp, Homo sapiens
  misc_feature: GYAE6OF01DDDQG.8.33.C11.1.454.CMB.1.raw
  modified_base (211)..(211): a, c, t, g, unknown or other
  misc_feature (211)..(211): n is a, c, g, or t
  modified_base (314)..(314): a, c, t, g, unknown or other
  misc_feature (314)..(314): n is a, c, g, or t
  modified_base (417)..(417): a, c, t, g, unknown or other
  misc_feature (417)..(417): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagatacccaccggagagattgtgttgacacagtctccagccaccctgtctttgtctccgaggggaaangcccaccctctcctgcaggaccagtcagaatgttggcgccttcgtaagctaggtaaccaacacaaacctggccaggcctcccacggcccctcatctagtggtncactccaacgacggggccacgtggaccactcccgagccgaggttcaggtggcaggtgggtagtgggacagacttcactctcacctatcatcacgccgtggacnccgtagaagtagttgttgacttagttttattaccgttgttaccaacgtacttaccggtaacggtacggttccgggtcccggttacccggggggtccctacggtttcccgggtaccccggttacgggaacccgtaaaggtcggtaaacgttaacgtaacccgtaaaaccggtaacgttacgggttacggtaccgttacgacctaacccgtacttaccgttacggttccctttccgttaacccg

SEQ ID NO: 262728 - DNA, 595 bp, Homo sapiens
  misc_feature: GYAE6OF01CMMFU.8.33.C11.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccacctctcctgcagggccagtcagaatgttggcgcctacgtatcctggtaccaacagaaacctggccaggcctcccaggcccctnatctatggtgcatccaacagggccactggcactcccagccaggtcagtgcagtggtatgggacagacttcactctcaccatcatcacgccgtggacgccgtaggaggtattggttgtcgtagtttaattacgtgtaccaactactaccgtaccgtacgtcggtcccggtccgggggtcctaccggtttcccgggcccgttacgggaacccgtaaaggttacggaacttaacgtaccgtaaaaccggtacgttaggtcggacgtcggacctacctacttcgttacgttccgttctaccg

SEQ ID NO: 262729 - DNA, 660 bp, Homo sapiens
  misc_feature: GYAE6OF01A5HK6.8.33.C11.1.454.CMB.1.raw
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcaggccagtcagatgtgcncttgagctgtaccaacacaacctggccaggctccaggcccctnatcttgatgctatccatcgagggcccacgtggcactccccgagccgtaggttcaggtggactagggtcgggtctacgggacacggtacttcaccgttctaccacctatccagccacgcctagacgtcctagtaagtactttacgacttaagttttaacttacgttacgtacctaacgtacgttaccgtaacggtacggttccgggtacccggtcccgggggtacccttaccggtttcccgggtaccccggttaccgggaacccgtaaaacgttacggtaaacgtaacgtaaccgtaaaaccggtaaccgtcgggtacggtaccgtacgtaccgtaacccgtacgttaccgttaccgttccgtttaccttaacccg

SEQ ID NO: 262730 - DNA, 635 bp, Homo sapiens
  misc_feature: GYAE6OF01D06NM.8.33.C11.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtggcgcttcgtagctgtaccaacacaacctgcaggctccagcccctnatctatggtgcactccaacgacgggccacgtcggccaactccccagcccgtaggttcaggtggcgaggttggggtatggggaactacggtacttcaccttctacacctatacatcgacgccgtggacgcctaggaacgtattggtcgtacttagtttacttacgttagtacctaacgtactaccggtaccgtaggtccgggtcccggtccgggggtcccttaccggtttccgggaccccggttacggggaacccgtaaggggtacgggaacgtaacgtaacccgtaaaacggtacgtagggtcggaccttgacccgtacgtacttaccgttcggttccttctacccg

SEQ ID NO: 262731 - DNA, 652 bp, Homo sapiens
  misc_feature: GYAE6OF01CY1HB.8.33.C11.1.454.CMB.1.raw
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaanacgccaccctctcctgcagggccagtcagagtcgttaccaccagttacgcctaggtaccaacacaaacctggccaggctcccaggcccctnactcttgatgcatccatcaggccatggcactccagcctaggttcaggtggctagggtcgggtcgtggggacacggacttcacttcctacaccgtatccgagcacgacctagacgcctaggtaagtatttacgacgtagttttacttactcgtactaactacgttaccgtacggtaacggttccggacccggttcccgggggacccttaccggtttcccgggcccgttacgggtaaccgtaaaacgtttcggaacgtacgtaaccgtaaaaccggtaacgttagggttacggaccgttacggaccgtaacccgtacttaccgttaccggtttcttacctacgtttacccccg

SEQ ID NO: 262732 - DNA, 622 bp, Homo sapiens
  misc_feature: GYAE6OF01AVGR8.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagaatgttggcgccttcgtaagctggtaccaacacaaacctggccaggcctcccaggcccctcatctatggtcgccatccaacgacgggccacgtggccatccccgagcctaggttcaggtcggctagggtgggtactggggactaggtaccttcaccttctaccacatcactccgacgccgtaggacgtcctaggaaacgtgtgttacgacttaagttttaactacgttagtactaactagttaccggtacgtgtccgggtcccggtacccgggggtcctaccggtttccggacccggtacgggtaaccgtaagggtcggaacggtaactacggaaacgtacgtcggcggtacctagacctacgtactcgtcgttcctcgtacc

SEQ ID NO: 262733 - DNA, 543 bp, Homo sapiens
  misc_feature: GYAE6OF01BILJB.8.33.C11.1.454.CMB.1.raw
  modified_base (209)..(209): a, c, t, g, unknown or other
  misc_feature (209)..(209): n is a, c, g, or t
  modified_base (314)..(314): a, c, t, g, unknown or other
  misc_feature (314)..(314): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgcttcgtaagctggtaccaacacaaacctggccaggcctcccaggcccctcatctatggtgcatccaacngggccactggcagtccccagccaggttcaggtggcaggtgggtatgggacaggacttcactctcaccatcgatcagcctggacgccgtgaagtatgttgctagtttattacgtgtacaactatcgtacgagtcggccgtccggggtccctacgtttccggcccgtcgggaccgtaggtcggagagtacgaaacgtactggtcggctgactaccatctcttcgttctacg

SEQ ID NO: 262734 - DNA, 1046 bp, Homo sapiens
  misc_feature: GYAE6OF01ANB7M.8.33.C11.1.454.CMB.1.raw
  modified_base (108)..(108): a, c, t, g, unknown or other
  misc_feature (108)..(108): n is a, c, g, or t
  modified_base (150)..(150): a, c, t, g, unknown or other
  misc_feature (150)..(150): n is a, c, g, or t
  modified_base (158)..(158): a, c, t, g, unknown or other
  misc_feature (158)..(158): n is a, c, g, or t
  modified_base (211)..(211): a, c, t, g, unknown or other
  misc_feature (211)..(211): n is a, c, g, or t
tcagctcgcgtgtccacgaccggtgctcgatttagagtgagctcgttggtttgggagaactgctcagttaggacccagaggaaccatggaagccccagctcagcttcncttctcctgctactctggctccagtttcagactaccacgganacgattgngttagacacagtctaccgagcctacctgtccttttgcctccgaaggggaaacncgccaacccttctccgtagcctaagggccctaagttccaaggtaaacttcggttacgggcctcccgttttaggtaaacgccgttacgggttaacccaaacgtaccgtaaaaccgtcgggaccctagggtacccttacccgtaacgggtccccctagtaacgttccgttaaacgttcgggttacgaccgtaacgttacccgtaaacgtacggggtacccttaaccggtcggtaacccgttaacgttacccccgtaacggtacccggttaacgggtttaccgtaacgggtttaccggtaccgtaacgggtttacggggttaacccgttacgggggtaaaccctaacggtaacccggttttaccgaaacccgtttaccgttaaacccggtaaccctacggtttaccgtaacggtttacccgtacgggttaacccgttacgggtaacgtaccccggttaaggtaaacccggtttaacgtttacgggtttaacggaacccgtttaacggtttttaacgttaacccgttaggtttaaacccgaacccgtttaacggtttaaccccggttaaacggttaccgggttaccggttacccccggtttaaccgggggttaaccccttaacccggttttttacccggggaccccgtttaaccgggggttaaaccccgttaagggggttaacccggttaaacgggttaaacccgtttaaacccgggtaaaaaccggtttacccggtacgggtttaacccgggttacccgtttaacggaaccccgttaaacccgggttacgtttaacccggtttaaccggtttacccggtttaacgtttaaaccccggg

SEQ ID NO: 262735 - DNA, 603 bp, Homo sapiens
  misc_feature: GYAE6OF01BG7DD.8.33.C11.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaangccaccctctcctgcagggccagtcagatgttggcgccttgaagctggtaccaacacaaacctggccaggctccaggcccctnatctatggtgcatccaacgacgggccacgtggcatcccagccaggttcagtggcaggtgggtatgggacagacttcactctcaccatcatcacgctgggctcgtagaagtgttgtacgtagttagtttactacgtctactaactacgtccgtaacggtggtccggtcccgggtccgggtaccttaccggttcccggtacccggtaccgggaaccggtaagggtcgggtaacgtaaccgtaaaccgtaaaccggtagttcgggtacggtcgtacgaaccctacgtacttacgtcgttccgttcgttacccg

SEQ ID NO: 262736 - DNA, 638 bp, Homo sapiens
  misc_feature: GYAE6OF01EFQBP.8.33.C11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagaatgttgcncttgtaagctgtaccaacacaaccgtgccaggctccagcccctcatctagtggtgcactccaacgcgggccacgtggccactcccgagccgaggttcaggtggcaggtgggtatgggacagtacttcactctacaccatcatcacgccgtaggacgtacctaggaagtacgttggttcgtacgttaagttttacttacttgttaacctaacgtagttaccgtaccggtacggtccgggtaccccggttcccgggggtcccttaccggtttccgggacccggtaccggggaacccgtaagggtacgggaacgtaacgtaccgtaaaaccggtacgtcgggtacggtccgtacggaccctaccgtacttacccgttcgttccttccgttacccg

SEQ ID NO: 262737 - DNA, 595 bp, Homo sapiens
  misc_feature: GYAE6OF01EBA51.8.33.C11.1.454.CMB.1.raw
  modified_base (298)..(298): a, c, t, g, unknown or other
  misc_feature (298)..(298): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtagtccagcctgggaggtcacagagacctctcctgtgcagcctctgggtcaccttcagtagctacggcatgcactcgggtccnccaaactccgaggcagggattggagtgggtggctagttgtttcatctggagggcagttgttacaagttggtatgctgacggtccgtaggaacgggccgtaattccacctaatcctaccgagacgaacactaccaaggaacacaatgttattcggacctagaacacgtacctaacgtcgtagacggacgacgggtagtaacgtactacgtaggtaaccggaaaggggacgggggaaccgagggacgggtacgttaccgaacggtaccttacgttacggacgtcggtcggggtacccgg

SEQ ID NO: 262738 - DNA, 632 bp, Homo sapiens
  misc_feature: GYAE6OF01ANHZ6.8.33.C11.1.454.CMB.1.raw
  modified_base (300)..(300): a, c, t, g, unknown or other
  misc_feature (300)..(300): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctcagggaaagagacaccctctcctgcagggccagtcagatgtgcgcttcgaagctggtaccaacacaaacctggccaggctccaggcccctcatctatgggtncatccaacgacgggcccaactggccactccccgagccaggttcaggtcggcaggtgggtatggggacaggtactttcgacttcctacgaacccagtaccactacgaagtccgtaggacgtccgtagaagtagtggttcgtacttagttttaacttacgtacgttaccaactacgtaccgtaccggtacggttaccggtcccggttacccggggggtacccttaacgggtttcccggtacccggtacgggtaaccgtaagggtcggaacgtacgtaaccgaaacggtactaggtcggcgtacgctaccgtacttccgtcgttccttcgtaccg

SEQ ID NO: 262739 - DNA, 639 bp, Homo sapiens
  misc_feature: GYAE6OF01D7U60.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtggcnccttgtaagctggtaccaacacaaacctggccaggctcccaggcccctnatctatggtgcatccaacgacgggccacgtggcactcccagccaggttcagtggcaggtgggtatgggacagacttcactctcaccatcatcacgccgtggacgccgtagaagtattggttgtacgtagttttacttacgtgttaccaaacgtacgtaccggtaaccggtaggttccgggtccccggttcccggggggtacccttacccggttttcccgggaccccgttacggggaacccgtaacggggtacgggaacgtaacgtaaccgtaaaaccggtaacgttagggtcgggacgttcggacccgtacccgtaacgttccgttacggttccttccgtacccg

SEQ ID NO: 262740 - DNA, 580 bp, Homo sapiens
  misc_feature: GYAE6OF01CPLZJ.8.33.C11.1.454.CMB.1.raw
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagctcgcgtgtccacgaccggtgctcgatttagagtgagctcgttttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaaangccaccctctcctgcagggccagtcagaatgttggcgccttcgtaagctggtaccaacacaaacctggccaggctcccaggcccctnatctatgggtgcatccaacncgggccacgtggcactcccagccaggttcaggtggcaggtgggtatgggacagacttcactctcaccatcatcagcctggagcctagaagtatgttgacgtagtttattactgtacaactacgtcgtacggtagtcgggtcccggtcccgggggtcctaccgtttccgggcccgtacgggaaccgtagggtcggtaacgacgtaaccgtaaacgtacgttggtcggcgtagaccgtacctatcgtacgttccttcgtaccg

SEQ ID NO: 262741 - DNA, 573 bp, Homo sapiens
  misc_feature: GYAE6OF01BZGW6.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaaacctggccaggctccaggcccctcatctatggtgcatccaacgagggccactggcatccccagccaggttcaggtggcaggtgggtatgggacagtacttcactctcacatcatcagtcctggacgcctagaagtgtgttcgacttagtttattaacgtgtacaactataccgtacgtagtcgggacccggttcccgggggcctaccgtttccgggacccgttcggggaaccgtaagggtggacgtaacgtaccgaaacgtacgtaggtcggctggaccacctagtcctgtcctctaccg

SEQ ID NO: 262742 - DNA, 622 bp, Homo sapiens
  misc_feature: GYAE6OF01BJY7N.8.33.C11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (609)..(609): a, c, t, g, unknown or other
  misc_feature (609)..(609): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgttgcncttcgaagctgtaccaacacaactgccaggctccagccctcatctatggtgcataccaacgacgggccacgtggacctactccccgacgcccgagggtttccaaggttcggactagggtggggtactggggaacaggtacttcactctacaccatcatccagcctgggacgcctaggaacgtacgttgttacgtacgttagttttactacgtagtacctaacgtacgttaccgtaacgaggttccgggccccggttccgggggtacccttaccggtttccggaccccggttacggggaaccgtaagggtacggacgtaacgtaccggaaacgtacgtaggtcgctcggactacctagtccgttnttcccgtcgtacc

SEQ ID NO: 262743 - DNA, 538 bp, Homo sapiens
  misc_feature: GYAE6OF01A1P8M.8.33.C11.1.454.CMB.1.raw
  modified_base (317)..(317): a, c, t, g, unknown or other
  misc_feature (317)..(317): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaacctggccaggcctcccaggcccctcatctatggtgcatccaacncgggccactggcatcccagccaggttcagtgcagtgggtatgggacagacttcactctcaccatcactcacgccgtggacgcctagaagatgttgctagtttatactgtacaactatccgtaccgagtcggcccgtcccggggtcctaccgttccggccgtcggaccgaggtcggagacgtacgaacgactggtcggctgcaccactctcgtcttcgtacg

SEQ ID NO: 262744 - DNA, 678 bp, Homo sapiens
  misc_feature: GYAE6OF01DBRBW.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacccttgtctttgtctccgagggaaagacgcccaccctctcctgcgacgggccagtcagtaagtggttcggcgtccttacgtaagctacggtaaccaacaaccaaccgtggaccacggcctcccgacggccccctcatctatggtcgacactaccgaacgacgggaccacgtcggcactcccacgcctaggttcaggtggacgaggtgggtagtacgggaactacgtacgttactacctctaccgacctatacctatccgacgtccgttagggacgtccgttaggaagtagttggttcgtacgttaagtttttacttacgttagtacctaactacgttccggtaccgtaggtccgggtcccggtacccggggtaccttaccggtttccggacccgtaggggtaaccgtagggtacgggtaagacgtaccgtaaaacggtacgttgggtaccggcgttcgaaccgtacctacgttccgtcgtttccgttctacccg

SEQ ID NO: 262745 - DNA, 767 bp, Homo sapiens
  misc_feature: GYAE6OF01B9L1U.8.33.C11.1.454.CMB.1.raw
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
tcagctcgcgtgtccacgaccggtgctcgatttagagtgagctcgtttggggttttgggggtactggggaagaggagcccgagccacgtagaagtcggcggtgtttccgattcggtgatcgagcactgaacacagtaggactcacgatggagttggctggactggtttcctgttgctctttaagngtntcagtgtcaatgcgaactggtgagtcgtggggagcgtagtccagccgtgggagtcacagagactctcctgtgcagcctcgtggttcaccttcagtagctacggcatgcacgtcgggtcccaccaaacgtccgaaggcgaagggtattgggagtggggtggctaggtttgtttacagttcgtagggagggtctaggttcgttacgaaagttggtaactggccgttacggaaccgtcccgggttaaggaaccggggtccctaacgtttaccgaacccgtattcccgtaccccaaagggaccgaaaccctaaaccgttacccgaaacggtaaacctaacgtaaacgttagtttaacgtttacggaacccgttagaaaccgtacggttacccttaaagggttccccgttaaggaacggtaccggttacgggttacttaacgttaaaccgttaacgttacgggaaacggggtaaacggggggaaacgggggtaacccgtaaacggggaccgggttaaacgttaaccccgtaaaggttacccgtttacccgggtttaaggtacccggtccgggttaacccggggg

SEQ ID NO: 262746 - DNA, 708 bp, Homo sapiens
  misc_feature: GYAE6OF01B6L9Q.8.33.C11.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcaggccagtcagaatgttgcgtctcgtanctggtaccaanacaaacctgccaggctccaggcccctnatctatggtgcatccaaacgcgggccacgtggcactccccagcctaggtcagtggcaggtgggtatgggacagacttcgactctcactatcatcgagcctaggacgtcctagaaacgtacgttaggttacgtaccgttaagttttactttaacgtacggttaacctaaacgtacgttaccgtaccggtaggttaccggggtaccccggttcccggggggtacccttaacccgggtttttcccggggtacccccgggttacgggggtaaaccccgggtaaacggggttacggggtaaaaccggtaaacggttaaacccggtaaaaaccgggttaaccggttacggggttacgggtaccgttaacggtacccgtaaccgttaacgttaccgtttacgttcccgtttaccgttaaacccg

SEQ ID NO: 262747 - DNA, 608 bp, Homo sapiens
  misc_feature: GYAE6OF01DT2XJ.8.33.C11.1.454.CMB.1.raw
  modified_base (314)..(314): a, c, t, g, unknown or other
  misc_feature (314)..(314): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcattctttggcgtcctttaacgngggccaggtggactcccagccaggtcagcgcagtgggtctgggacttcgtcactctcacatcaatacctgctaatctgacgtactttgtctagtttattctgtcagtctagtctagaacgtacgtcggtccgttacgtaccgttttcgggaccggggtaagggtaacccgtaaaggggtcggacccgttaacgaaaaccggtaacgttcggttacgggccgtcggtaccaccctagttacccttggttaccctttacgtaacttccccgtttacccccgcccgtacgttacccg

SEQ ID NO: 262748 - DNA, 614 bp, Homo sapiens
  misc_feature: GYAE6OF01EITW5.8.33.C11.1.454.CMB.1.raw
  modified_base (211)..(211): a, c, t, g, unknown or other
  misc_feature (211)..(211): n is a, c, g, or t
  modified_base (598)..(598): a, c, t, g, unknown or other
  misc_feature (598)..(598): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagtattgtgttagacacagtctccagccaccctgtctttgctccgaggggaaanagccaccctctcctgcgagggccagtcagaatgttggcgccttcgaagctaggtaccaacacaaaccgtggccagcctcccaggcccctcatctagtggtgcctagtaccgaacgacgggaccacgtcggacacgtcccagcctaggttacaggtcggacaggtggtatgggacaggtactcactctacacatcatcagtcctggacgtcgtagaagtacgtgtacgtacgttaagttttactacgtcgtaaccgtaactagttaccgtaacggtaggtaccgggtacccggtccggggtaccctaccggtttcccggccgtaccgggtaccgtaagggtcggacgtacgtaacgaacgtacgtcggtcggctagcccgtactactnttacgtcttcgtaccg

SEQ ID NO: 262749 - DNA, 630 bp, Homo sapiens
  misc_feature: GYAE6OF01EK50Q.8.33.C11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagatgtgcncttganctgacacacaacngcngctccagccctnatctatgtgcatccaacgacgggaccacgtggaccactaccccgagccgtaggttcaacggtggcgagggttgggtcgtgggtactttcggttcacgttctaccaccgtatacaacgttaacctgactaagtcctaggtaaccgttactttgactttaagttttactttctcgttacagtacgtagttcgtacggtaacgtcgttacggtcccgttacgtacggtttcgggaccgggtaacggtaaccgtaacgggtacgaacccgttaacgaaaccggttacgtaggtcggtacctacggtccaaccgtgtaccgttacgttcctttacgtacttcccgtaccccggtac

SEQ ID NO: 262750 - DNA, 546 bp, Homo sapiens
  misc_feature: GYAE6OF01B3EVL.8.33.C11.1.454.CMB.1.raw
  modified_base (406)..(406): a, c, t, g, unknown or other
  misc_feature (406)..(406): n is a, c, g, or t
  modified_base (435)..(435): a, c, t, g, unknown or other
  misc_feature (435)..(435): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggcccctcatctatggtgcatccaacagggccactggcatcccagccaggttcagtgcaggtgggtatgggacagacttcactctcaccatcatcagtcctggacgcctagaagtntgttgctagtttacttacgtgtacaactntaccgtacgagtcggcccgtccggggtcctacgtttcggcccgtgggaccgaaggtggacgagtacgaaacggtagtggtcggctgaccactacttctcgttcttcgtacc

SEQ ID NO: 262751 - DNA, 541 bp, Homo sapiens
  misc_feature: GYAE6OF01B1WX6.8.33.C11.1.454.CMB.1.raw
  modified_base (258)..(258): a, c, t, g, unknown or other
  misc_feature (258)..(258): n is a, c, g, or t
  modified_base (451)..(451): a, c, t, g, unknown or other
  misc_feature (451)..(451): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaanctggtaccaacacaaacctggccaggcctcccaggccccctcatcctatggtgcatccaacgagggccacgtggcatccccagccaggttcaggtggcaggtgggtatgggacagacttcgactctacaccatcatcacgcctggacgcctgaacgtatgttgactagtttatactgtacaactatcgtacgngtcggccgtcggggacctcgttccggcctcgggaccaagggtcggagaacgtacgaaacgtacgtggtcggctgccacatctgtctctac

SEQ ID NO: 262752 - DNA, 597 bp, Homo sapiens
  misc_feature: GYAE6OF01D7UAA.8.33.C11.1.454.CMB.1.raw
  modified_base (294)..(294): a, c, t, g, unknown or other
  misc_feature (294)..(294): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaagcgccacctctcctgcagggccagtcagatgttggcgtccttgaagctggtaaccaacgacaaacctggccaggctccaggcccctnatctatggtgcataccgaacgacgggccacgtggacactccccagccaggttcaggtcgcgaggtgggtatgggacagtcttcactctacaccatcatcacgcgtggacgctagaagtagttgttacgactagttttactacttcgtactaactagttccgaacggtgtacgggcccggtaccgggggtaccttacggtttcccggaccgttacggggaccgtaagggtcggaacgtaagtacccgaaaacggtacgtggtcgggaccttacgacctacttactcgttcgttcgttcgtaccg

SEQ ID NO: 262753 - DNA, 807 bp, Homo sapiens
  misc_feature: GYAE6OF01DGUTT.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagactaccaccggagagtattgtgttgacacagtctccagccaccctgtcttgtctccgagggaagacgccacctctcctgcgaggccagtcagatgttggcgtccttgaagcgtcggtaaccaacgacaaacctggccgacggcctcccgacggcccctcactctagtgggtacacaactacccgaaaccgacgggaccctaaccgtacggacctacgtccccgaacggcccgtaacgggtttcgaacggttaggaccgtaagggttggggttaagtcggggaacctacggtaacctttacgacccttcgtacctaactactcctaatccgtaacggtcccgtagggacgtacccgttaagaaacggttagttaggtttacgtaactttaagtttttaacgttaccgttacgttaaccgtaaacttacgtttacccgggtaacgggttaccgggttacccggggtaccccgggtaccccgggggttacccttaaccccgggttttcccgggaccccgggtttaaccggggaaaaccgttaaacgggtaccggttaaagtaaccgttaaaaccggtaaaaacgtaacccggtttacggtccggtacggtacccgtaacccgtaaccctacgttaccgtttacgttacccgttaccgttaacccg

SEQ ID NO: 262754 - DNA, 631 bp, Homo sapiens
  misc_feature: GYAE6OF01E3QPF.8.33.C11.1.454.CMB.1.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcgccttcgtaagctggtaccaacacaaacctggccaggctcccaggcccctcatctatggtncataccaacagggccactggccactcccagccaggttcagtggcaggtgggtatgggacagacttcactctcaccatcatcacgcctggacgcctaggaaagtacgtggtttcgacgttagttttaacttaccgttacgttaccaaacgtacgttaccggtaaccggtacgggttacgggccccggttccccggggggtacccttaccggttttcccgggaccccgttacggggaacccgtaagggtcggtaagaacgtaccgaaaaccggtaactcggtcggccgtagacctaaccctagttacctcgttcttccgttaccg

SEQ ID NO: 262755 - DNA, 572 bp, Homo sapiens
  misc_feature: GYAE6OF01B0LQR.8.33.C11.1.454.CMB.1.raw
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccacggcccctcatctatggtgcatcccaaacgacgggccacgtcggccatccccgagcccgaggttcaggtggcaggtgggtatgggacagtacttcactctcaccatcatcagcctggacnccgtgaagtntgttcgctagtttattacgtgtaccaactatccgtacgagtcggtcccggtcccgggggtcctaccgtttccggcccgtggggtaacccagggtcggagaactaccgaaacgtacgtggtcggcgtgaccgtaccatactcgttctctaccg

SEQ ID NO: 262756 - DNA, 827 bp, Homo sapiens
  misc_feature: GYAE6OF01CI8TU.8.33.C11.1.454.CMB.1.raw
  modified_base (161)..(161): a, c, t, g, unknown or other
  misc_feature (161)..(161): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttggctgaactgggttttccncgttgcttctttaagaggtgtccagtgtcaagtgcaacgtggtggagtcgtgggggaggcgtagtccagccgtggggaggtcacgagacgacttcgtcctggtcgccaggcccttcgttacggggttccaccctttacgaaggttaacgccgttacgggaccagttcggacctaaccgtcgggggtaccccaacccgtaaaacctcccggaagggaccgaaagggggtatttggggaaggttgggggtgccgttaaggtttcgttttacgattcggtaggacgggtctaaggtttgttaccgaaaggttgggttaatcggtacctttacgggacccgggtaccgttaggggaaaccggggtacccggtaacgttacccgtaacccgtacgttaccgttacccgaacggtaaccgaaacccgtaacccgtacccgaaacgggaaacctaaaccgtaaacgtttacggtttaacgtttacggaacccgtaacgtaaaccgtaacgtacccggttaacgtccgtacgaacggtaacggtacgggtagtaagttaccgtacggttacggtaacgggaacggggaacgggggtaaccggacggggtacgggtaaacggttaccggtaacggttacgttaccggtttacggtccgggttcggtacccggggg

SEQ ID NO: 262757 - DNA, 665 bp, Homo sapiens
  misc_feature: GYAE6OF01BDXSD.8.33.C11.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccaccctctcctgccaggaccagtcagaatgttggcnccttgaagctaggtaccaacacaaacctggccaggcctcccaggcccctcatctatggtcgacctactacccaacgacgggcccacgtcgggcacgtccccgagcccgtaaggttcaggtcggacgtaggtgggtagtcggggactaggtaccttcactctacacccatacatcacgccgtaggacgtccgtaggaacgtaagttgttagtacgttaacgttttattacttacgtactaacgtacgttacgtaccgtacggtcggtcccggtccgggggtacccttaccggttttacccgggcccggttacgggtaacccgtaagggtcggtaacgtaacggtaaccgaaaccggtaactcgggtcggaccgttcgacccgtaaccgtacgttcgttccgtttaccttccgtaccg

SEQ ID NO: 262758 - DNA, 811 bp, Homo sapiens
  misc_feature: GYAE6OF01CZ6X0.8.33.C11.1.454.CMB.1.raw
  modified_base (319)..(319): a, c, t, g, unknown or other
  misc_feature (319)..(319): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaagacgccaccctctcctgcagggccagtcagaatgttggcgccttgtaagctaggtaaccaacacaaaccgtggaccaggcctcccgacggcccctacactctagtggtcncactaccaacgacgggccacgtcggaccaacgtccccgagccgtaggttaccaaggtcggacgagggttgggtagtggggaactacggtaccttcgaaccttccgtaccgtaacctacttacaacgttcccgtaacggtcccgttacggggaacgtacccgtaaggtaaacggtagtttacggtttacggtacgtttaagggtttttaacttaaccgttacggttaaccctaaaccgttaacggttacccggttaaccgggttaacgggtccggggttacccccgggttcccggggggttacccttaacccgggttttccccgggtaccccgggttacgggggtaaccccggtaaacggggttaccgggtaaacggtaaaccgttaaccgggaaaaaccgggttaaccggttgggttaaccgggtacccgttacggacccgttaacccgttaacgtttcccggtttacggtttaccttacccgtttaacccg

SEQ ID NO: 262759 - DNA, 613 bp, Homo sapiens
  misc_feature: GYAE6OF01D1BW7.8.33.C11.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (488)..(488): a, c, t, g, unknown or other
  misc_feature (488)..(488): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangcccaccctctcctgcagggccagtcagaatgttggcgccttcgtaagctggtaccaacacaaacctggccaggctcccaggccccctnactctatggtgcatcccaacgacgggcccacgtggcctactccccgagcccgaggttccaggttggctaggtggggtaagtcggggaacaggtaccttcgaaccttcctacacccatccatccacgccctgggacnccgtagaagtntgttgacttagttttattacctgtaccaactagtaccgtacgngtcgggcccgtacccggggtacctaccgtttccggcccgtcggggaacctaagggtcgacgaatacccggaaaacgtacgtcggtggacctggaccctacctacttcgtcgttccttccgtaccg

SEQ ID NO: 262760 - DNA, 562 bp, Homo sapiens
  misc_feature: GYAE6OF01DUX7J.8.33.C11.1.454.CMB.1.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggcctcccaggccccctnatctatggtgcatccaacgacgggccactggcactcccagccaggttcagtggtagtgggtatgggacagtactcactctcaccatcatcagcctggacgcctagaagtatgttgactagtttattactgtacaactactcgtaccgagtcggcccgtccggggcctacgttccggcccgtagggaccgtaagggtggagacgtacgaaaccgtacgtggtacggtctacgccaaccgtagtcttagttcttcgtcttccccg

SEQ ID NO: 262761 - DNA, 690 bp, Homo sapiens
  misc_feature: GYAE6OF01CA8RX.8.33.C11.1.454.CMB.1.raw
  modified_base (216)..(216): a, c, t, g, unknown or other
  misc_feature (216)..(216): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccctagtttcagataccgaccggagagtattgtgttgacacagtctccagcccaccctgttctttgtctaccgagggaaanacgccaccctctcctgcaggccagtcagtatggtggctccgttagagtctaggtaaccaacgacaaaccgtggaccaggccctcccgacggtcccctcacttctagtggtacacctaacaccaacgacgggaccacgtcggacctaacgccccgaacggtcctaagggttccaagggttccggaggtagggtaggggttaacgacggggaacacgttacgttaccaccttactacccaactaagtaccaactccgaacgtccgtaggacgtccgtagaaagtcgttagtgtaacgttagttttattaccgtagtacctaagtactaccgtaccggaggtccggtccggtacccggggtacctaccggttccggaccggttacggaacgtacgggtacggtaagtaccgtaacggaacgtacggtaggtcggaccgccgtacctaccgtattaccgttcgttccttcggttaccc

SEQ ID NO: 262762 - DNA, 873 bp, Homo sapiens
  misc_feature: GYAE6OF01EAZTM.8.33.C11.1.454.CMB.1.raw
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacgttgggttttcctcgttgcttcttttaagnggtgtccagtntcaagtgcacgtggtggagtcgtggggagcgtagtccagccgtgggagtcacgagacgacctcgtcctggtcgcacgtcccttcgttcgggttcctacccgtttcgaaggttacgccttaacggcctagttcgcctacgtcggggtacccgaccctaaaacgtccgaagggacgtaaacggggtacttgggaggttcgggggtggtccgttaaggttttcgtttacgagttcgtggacgggtctaagggtttcggttaactaagttcgggttattcggtccgttagggaacccggtcccggttaagggaaaccggggtcccttaagtttacccgaacccgtacgttaccccgttacccgaaacggtaaccggaaacccgttaaaacccgttacccggtaaaacgggtaaaccgtaaacgttaacggtttaacgtttaacggttttaccgggtaaacccgtttaacggtaaacccgtaaccggttaacccgtttaaaccggtttacccggtaacggtaacggggtaacccgtaacggggttaacgtaacgttaaccgttaacggtaacggtaaacccgggtaaaggggaaccgggggtaaaccgtacgggaccgggttaacgtaaccggtaacggttaccgttaccgtttaccggtaaccggttggtaccggggtaccgttccggggttaccccgg

SEQ ID NO: 262763 - DNA, 787 bp, Homo sapiens
  misc_feature: GYAE6OF01CY4JC.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggcctccagtttcagataccacggagagattgtgttgacacagtctccagccacctgtctttgtctcgaggggaaancgccaccctctcctgcgagggccagtcaagtaagtggttcggcgtccgttcggtaacgccgttacgggtaacccaaaccaaccaaaacccgtgggacccaagggccctacccggaccggaccccctctaactccgttaacgtgggtacacctacgtacccaaacgacggggacctaaccggtggaccaccgtacccacggtaccgtagggttaccagggtcggacgtaggggtgggtaaggtcggggaactacgtacttacgactcctacaacctatacagtaccgacgtccgtacgggacgtaccgtagaaacggtgttacggttagtaccgttaaggttttaactacgttacgttaaccaaccgtaggtttaacccggaccgggtacgggttccggggaccccgggttacccggggggtacccttaacccggggtttccgggaccccgggttaacgggaaccggttaaacggggtcgggaaaccgtaacgtaaacccggtaaaacggtacggtacgggtcgggtacctacggtacccgtaaccgttacgttccttacggttccttacgttaaccccg

SEQ ID NO: 262764 - DNA, 769 bp, Homo sapiens
  misc_feature: GYAE6OF01CRSCO.8.33.C11.1.454.CMB.1.raw
  modified_base (206)..(206): a, c, t, g, unknown or other
  misc_feature (206)..(206): n is a, c, g, or t
  modified_base (739)..(739): a, c, t, g, unknown or other
  misc_feature (739)..(739): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctcacgccacctgtctttgtctcgagggaaancgcccaccctctcctgcgacgggccagtcagaatgttggctcgttacgtaagctagtaccaacaacaaaccgtggccaacggctcccgacggcccctcacttctagtcggtagccatacccgaaacgacggggcccacgtcgggacctacgtccccgaagtacccgtaaggtttccgaacggtcggacgtaagggtttcggggtaacgttacgggggtaacgtaacggtaacctttaccgaccgtttacctacccgtaaccgtactacgtaccgttaaccgtaaccggtaccggttacggggtaacggtacccgttaagggaagttaacgtttacggtttacgtacgtttaaaggtttttaacctttaacgttacggttacctaaacttacgttaccgtaacggtcggtaccgggttcccggtcccggggggttaccctaccggtttcccgggaccccggttacggggtaacccgtaaggggttacggaacgttaacgtaaccgtaaaccggtacgttggtacggaccgtacnccgtacctacgtcttcgtccctttgtaccc

SEQ ID NO: 262765 - DNA, 568 bp, Homo sapiens
  misc_feature: GYAE6OF01BCP1J.8.33.C11.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaanacgccaccctctcctgcagggccagtcagaatgttggcnccttgtaagctggtaccaacacaaacctggccaggcctcccgacggcccctnatctagtggtgcatccaacgngggcccacgtggcactcccaggcccaggttcaggtggcaggtggtatgggacaggtactcactctcaccntcatcacgcctggacncctagaacgtntgttgctagttttatacgtgtacaactagtaccgtacgngtcggtcccggtccggggtcctacgttccggccgtacggacgagggtcgagactaacggaaccgtagtggtcggcttagaccctacgtacttcgtcgttcctctaccg

SEQ ID NO: 262766 - DNA, 561 bp, Homo sapiens
  misc_feature: GYAE6OF01B4DAJ.8.33.C11.1.454.CMB.1.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (549)..(549): a, c, t, g, unknown or other
  misc_feature (549)..(549): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcnccttcgtaagctggtaccaacacaaacctggccaggctcccaggccccctnatctatggtgcatcccaacgcgggcccatggcactcccagccaggttcagtggcaggtgggtatgggacagacttcactctacaccatcatcacgcctggacgcctagaagtatgttagactagtttaattacttgtactaactactaccgtacgacggtcgggtcccgtccgggggtaccctaccgtttccggcccggtaggaccgtaaggtcggagacgtacgaaacgtatcggtcggctgctaccatntcgtcttctacc

SEQ ID NO: 262767 - DNA, 627 bp, Homo sapiens
  misc_feature: GYAE6OF01DP72R.8.33.C11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
tcagctcgcgtgtccacgaccggtgctcgatttagagtgagctcgttgggtttgggggaggaactgctctagttaggacccagagggaaccatggaagccccagctcagcttctcttcctcctgctactctggctcccagtttcgagataccaccggagagattgtgttgacacagtctccagccaccctgtctttgctccaggggaaangccacctctcctgcagggccagtcagatgttggcgcttacgtaagctaggtacaacacaaacctgccagctccagcccctnatctatggtgcatccaacacgggccactggcactcccagccaggttcagtggcaggtgggatgggacagacttcgactctacaacctatacgactacgaacgcccgtagggacgtccgttaggaacgtaagttcggttacgacttaagttttaacttaaccgttaggtacctaaacgtacgttaccggtaaccggtacggttcgggtaccccggttcccggggggtaccttaccgttttcccgggcccggtacgggacccgtaaacgggtgacgtactaccgaaaacgtacgtacggtcggccgttgaccctaccagttccttcgtccttcgtacc

SEQ ID NO: 262768 - DNA, 694 bp, Homo sapiens
  misc_feature: GYAE6OF01CO7VV.8.33.C11.1.454.CMB.1.raw
  modified_base (207)..(207): a, c, t, g, unknown or other
  misc_feature (207)..(207): n is a, c, g, or t
  modified_base (676)..(676): a, c, t, g, unknown or other
  misc_feature (676)..(676): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgagggaancgcccaccctctcctgcgacgggccagtcagtaatggttgcgtccttgaagtctaggtaacccaacaaccaaaccgtggaccagggtccctacccgacggccccctcactccgtagtcggtcgacactacccgaaacgacggggaccctaacgtcgggacctaccgtaccccgacgtacccgtaagggttcaagggtcggacgtagggttaggggtacgttacggggaactacggtactttccgaacctccttaccgaaccctagtcctactacgacgtccgtaggactcgtagaagtagttacgttgtacttaagtttattcgtagttacaacgtacgtaccggtaacgtacggttccggacccggttacccgggggtccttaccggttccggtacccggtacgggaaccggtagggtacggacgtaacgtaacggtaaacggtagtcggtcggacgtcgacgtactntcgttctcgttcgtaccg

SEQ ID NO: 262769 - DNA, 827 bp, Homo sapiens
  misc_feature: GYAE6OF01DKCFQ.8.33.C11.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctccgaggggaaagngcccaccctctcctgcagggccagtcagtaatgttggccgtccttacgtaagctaggtaaccaacacaaaccgtggccaggcctcccgacggtccccctnactccgtagtggtcgcactaccgaacgacgggccctacgtcggacctacgtaccccgaggcccgtaagggtttccaggtcggacgtaggggttcgggggtaagtacgggggaactaacggtacctttaccgaccgttacctacccaaccctactacctacgtaccgaaccggtcccgttacggggaccgtacccgttaagggtaaacggtagtttcgggtttacgtacgtttaagtttttaaccgtttacgttacgttaacctaaaccgtacgtttacccgggttaaccggtaaccgggttaccggggtacccccgggttaccccgggggggtaccctttaacccgggttttccccggggtaccccggttaccgggggtaaacccgggttaacggggttacggggtaaaccggttaaccggtaaaccggtaaaaacccgggtaacgttacgggttaccgggtaccgtacggaccctaaccgttacgttaccgtttccggttcctttcggttaaccccg

SEQ ID NO: 262770 - DNA, 701 bp, Homo sapiens
  misc_feature: GYAE6OF01DBGUT.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcgtgggggaggcgtagtccagccgtgggaggtcacagagctctcctgtgcagcctctgggttccaccttcgagtagcctacggcagtcgcacgtcgggtcccaccaaactccgaggcaagggtgtgggagtggggtgcgtaggtttcgtttacattcgtggacgggtctaggttgtttacaagttggtatggctggacggtccgtagggaacggggtccgtacttccgaacctagtacctacccgagaacgaaaccaacccgttacccgaaggaaaccctaacgaatttacggtttaactttacgggaacccttaggaaaccacggttaaccctaacggttccgagggtaacggacggtaccgggttagtaacttacgtaccgttaggtaacgggtaaacgggggaacgggggaaccgtagggaccggggtaacgttacccggaacggtttaacccttcggtttcggaccggttccgggtaccggggg

SEQ ID NO: 262771 - DNA, 567 bp, Homo sapiens
  misc_feature: GYAE6OF01BF4UT.8.33.C11.1.454.CMB.1.raw
  modified_base (210)..(210): a, c, t, g, unknown or other
  misc_feature (210)..(210): n is a, c, g, or t
  modified_base (465)..(465): a, c, t, g, unknown or other
  misc_feature (465)..(465): n is a, c, g, or t
  modified_base (551)..(551): a, c, t, g, unknown or other
  misc_feature (551)..(551): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagagtgttaccaccagttagcctggtaccaacacaaacctggccaggcctcccacggcccctcacttctttgatgcactccatccagggccacgtggcactcccacgccaggttcagtcggcagggtgggtcgtagggacagtacttcactcctcaccatcagcacgacctagacgccgtagtaagtattttcgacttagtttaattacttgtacaactactcgtacgngtcggccggtccggggcctaccgttcggcccgtaggaacctaaagtcggagtactacgaaacgacgtagcggctcgacactctctntccttcgtacttcccg

SEQ ID NO: 262772 - DNA, 652 bp, Homo sapiens
  misc_feature: GYAE6OF01CCO26.8.33.C11.1.454.CMB.1.raw
  modified_base (207)..(207): a, c, t, g, unknown or other
  misc_feature (207)..(207): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagaatgttggcgccttcgaagctggtaccaacacaaacctggccaggctcccaggcccctcatctatggtgcactccaaacgacgggcccacgtggccactccccaaggcccgtaaggtttccaaggttcggacgtagggttaggggtaatggggaactaggacctttcgacttctacacctatcatcacgcctggacgccgtagaagtatgttgactagttttaacttacttagtaccccctaagtacgtaccgtaacgacggtcggtacccggttcccgggggtcccttaaccggtttccgggaccccgttaggggaacccgtaaggggtacggaacgtaacgtaaccgaaaaccggtaacgtacggtacggccgtacgaccgtaacctacgttaccgttcgttcctttccgtaaccg

SEQ ID NO: 262773 - DNA, 572 bp, Homo sapiens
  misc_feature: GYAE6OF01BCC55.8.33.C11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
  modified_base (400)..(400): a, c, t, g, unknown or other
  misc_feature (400)..(400): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgttgcnccttcgaagctggtaccaacacaaacctggccaggcctccaggcccctnatctatggtcgcatccaacgagggccacgtggcatcccagccagttcagtggcaggtgggtatgggacacgtacttcactctacacctatcatcacgtcctggacncctagaagattgtgctagtttatacgtgtacaactactccgtacgcggtcggcccggtcccgggggtacctaccggttccggcccgtacgggaccgtaagggtcggaacgtacgtacgaaacgtacgttggtcggacgtcgacctacctagtacctcgttccttcgtacccg

SEQ ID NO: 262774 - DNA, 915 bp, Homo sapiens
  misc_feature: GYAE6OF01DQMM4.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgttctttgtctccgagggaaagcgcccaccctctccgtgcgagggccagtcagtaatggttggcgtccttcgaagctggtaaccaaccaacaaaccgtcggaccacggcctacccgacggtccccctctacttcgtaagttcgggtacgcgtaacctacccgaaaaccggtaccggggaccctaacgtcgggaccctaaccgttccccgaaacggtcccggtaacgggtttaccgtacggggttacgggaccggttaaaggggttacggggtaaacggttaccgggggaaacgtacgggttaacccttttaccgaaacccgtttcccgtaacccaaacccgttacttaacccgtaacgttacccgtaccgggttacccggtaacggggaaccgttaccccgttaaagggtaaaaacgtcgtttaacgggtttacgtacgttttaaaggttttttaaccttaaccgtttgtaaccctaaacgttacggttaacccgggttaacgggtaacgggttccccggggaccccggggttccccgggggttaacccttacccggggttttaccccgggaccccgggttacggggtaaaccccgttaaagggggtcggtaaaccggtaaaccgtaaaccggtaaaacccgggttaggttacgggttcggggttaccctaacgggtaccccttaaacgtcccggtttaccgttccgttacgttttcccgtaaccccg

SEQ ID NO: 262775 - DNA, 780 bp, Homo sapiens
  misc_feature: GYAE6OF01DBOSK.8.33.C11.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagtattggtgttgacacagtctccagccaccctgtctttgctccgaggggaaancgccaccctctcctgcagggccagtcagtatggtgcctcttacgagctgtaccaacacaactgcagcctccgacgccctnactctagtggtcgcactaccgaacgccgggacctacgtcgggacctacctaccccgagccgtacggttaccaggggttacggacgtaggggtacgggttagtacggggtaacacggttaccttacgaccttcctaaccacctacgtctaacgtcgaaccgtccggtacgggtaccgtacccgttaaggtaaacggttacgttacggtttacggtaacccgttttaagggttttaactttaaccggtttacggttaaaccctaaaccggttacgttacccgggttaaccgggttcgggttacccggggtacccccggggtttaccccgggggtacccgttttaaccccgggtttcccgggtacccgggtacggggtaacccggtaagggtacggaaccgtaccgtaaaccgtaaaccgggttacgtcgggtccgtaccggtacttacccggaccgtttaagtccccggtttattcccgttacgttaccccg

SEQ ID NO: 262776 - DNA, 617 bp, Homo sapiens
  misc_feature: GYAE6OF01CJAUF.8.33.C11.1.454.CMB.1.raw
  modified_base (287)..(287): a, c, t, g, unknown or other
  misc_feature (287)..(287): n is a, c, g, or t
  modified_base (616)..(616): a, c, t, g, unknown or other
  misc_feature (616)..(616): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccagaacacaatgtatttggacctgaacagcctaagtcctgaggacacgggtntactactacgtgtacggaagggacgggggaaccaggcgggattaccgaagtacctccgttgacgtcgtcggggccagggtaccctggtaccaccgtctcctcacgccctacccgaccgaacgggcccagttcccggtcccttcccccgtcgaccgtcccctcgccctaccgacggacgccgacccgtccggacgaccgaccgacgacggccggcccgtcgggccgtcggccgtacgggtaccgaacggtaccctaccgttaccgaccgaccggcgacgcgtacggacggcgggcgtcgggaccgaacgggccgtacgacgtagctgcgng

SEQ ID NO: 262777 - DNA, 736 bp, Homo sapiens
  misc_feature: GYAE6OF01EFYB6.8.33.C11.1.454.CMB.1.raw
  modified_base (542)..(542): a, c, t, g, unknown or other
  misc_feature (542)..(542): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaagcgcccaccctctcctgcgacgggccagtcaagtagtggttcggcgtccgttagtaacgcgtacggtaaccaacaacctaaaccgtcggaccacggtcctcccgaccggtccccctatacttcgttagtcgggtacgacctaacgtacccgaaacggaccgggaccctacggtcggacctaaccgtaccccgacggtaccgtacggttaccgacggggttcggacggtagggttaggggttacggtacgggaactacggttaccttcgaacctcgtaccaactacttactaacgttccgaacggtccgttaagggaccttaccgtaagaaaggtntttcggtacgtactttaagttttactacgtacgtaacacgttacgtccgtaacggtcggtaccgggcccggtccggggtacccttacggtttcccgggccgtacggggaaccgtagggtacgacgtacgtaacgaaaaccggtgtacgggtgtacccgtagacccgtactactcggttcgttccttcgtacccc

SEQ ID NO: 262778 - DNA, 726 bp, Homo sapiens
  misc_feature: GYAE6OF01BG3M7.8.33.C11.1.454.CMB.1.raw
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcaggccagtcagatgttggctccttcgtaagctggtaccaacacaaacctggccaggcctccacgccccnatctatggtgcactaccaacgacgggccaacgtcggctacgtaccccagtcccgtaggttccgaggttcggacgtagggtagggtacgtacggggacgtaacggtacctttacgaaccttctaccgaaccctataccaacttccgaacgtcccgttagggacgtacccgttaggaaagtagttacggttacgtacgttaacggtttttaacttacgttacggttaacctaaccgttacgttaccggtaaccggacgggttccggaccccgggttccgggggtaccccttaccgggttttcccgggacccggttacgggaaccggtaacggggtacgggtaacgtaaacggttaaccgaaaaccggttacgttacgggtacggtaccgtacgaccgtaccgtacttaccgttcgtttaccgtccgttaccg

SEQ ID NO: 262779 - DNA, 604 bp, Homo sapiens
  misc_feature: GYAE6OF01B4CE6.8.33.C11.1.454.CMB.1.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttgacgtccttcgtaagctggtaccaacacaaacctggccaggcctccacggcccctcactctatgggtncactccaacgacgggcccaacgtcggccactccccgagcctaggttcaggtggcaggtggggtatgggacagtacttcactcncacctatcatcagcctggacgcctagaacgtattgttgacttagtttacttactcgtacaactacgtccggtaacgacggtcggcccggtcccgggggtacccttaccggtttccgggacccgttacgggaacccgtaagggtacgggaacgtacgtaccgaaacggtacgtggtcggcgtacgcctacgacttacgtcttcgttctaccg

SEQ ID NO: 262780 - DNA, 607 bp, Homo sapiens
  misc_feature: GYAE6OF01E4UUS.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcgccttcggtaagctggtacccaacacaaaccgtggccaggcctcccgacggcccctcatcctagtggtgcactaccaacgacgggccacgtcggacactccccagccgaggttcaggtggacaggtgggtagtcgggacacgtactcactctacaccatcactcacgccgtaggacgtccgtagaagtatggttagacgttagttttaacttacgtgtaccaacgtactccgtacggtaggtccgggcccggtcccgggggtaccctaccgtttccggcccgtacgggaaccgtagggtcggacgaacgtaccgaaacgtacgtggtcggctcgacctaccactcttcgttctcgtaccg

SEQ ID NO: 262781 - DNA, 652 bp, Homo sapiens
  misc_feature: GYAE6OF01CG1XV.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (279)..(281): a, c, t, g, unknown or other
  misc_feature (279)..(281): n is a, c, g, or t
  modified_base (285)..(285): a, c, t, g, unknown or other
  misc_feature (285)..(285): n is a, c, g, or t
  modified_base (288)..(290): a, c, t, g, unknown or other
  misc_feature (288)..(290): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (301)..(302): a, c, t, g, unknown or other
  misc_feature (301)..(302): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagatgttgcnccttgagctgacaacacaactgcagctccagccnnnctangtnnncagngcangcnnccngcngtcagtgcagtggatggacagtctcactcncacatcgatcacgtcgtacggacgtacccgttaggaacgtgttaggttcgtacgtttaaggttttactttaacgttacgtaacctaaacgtacgttaccgtaaccgggtaacggttcccggggtaccccgggttaccccgggggtacccgttacccggtttaccccggggtaccccggtaccggggtaaaccggtaaacggggtacgggtaaacggtaaccgtaaaccggtaaaacggtaaccggttcgggtaccggtaccgtacgtacccgtaacctaacgtttcccgtacgtttaccgttccgttaaccccg

SEQ ID NO: 262782 - DNA, 654 bp, Homo sapiens
  misc_feature: GYAE6OF01AFVSL.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaanacgccaccctctcctgcgacgggccagtcagacgtcgttaacccaccagttacgcctaggtaaccaacaaccaaacctcggccacggcctcccacggcccctcattctttgactgctatccatcgacgggccactcgggccacgtacccacgccgtacggttccaggtcggcgaaggttcggggtcgtaggggacacggtacttctaccgtcctaccgaccactcgacgcacgacctagacgcctagtaagtactttgacttacgttttattactagtactaactacgttacggtacgtacggttccgggtcccggtcccgggggtacccttaccgtttcccgggacccgttaccgggtaacctaaacgttcggaacgtactaacgaaaccgtacggtaggtacggcgtaccgacacctacgtacttacgttcttcgtcttccccg

SEQ ID NO: 262783 - DNA, 548 bp, Homo sapiens
  misc_feature: GYAE6OF01C5XLN.8.33.C11.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagatttgtgttgacacagtctccagccaccttgtctttgtctccgaggggaaangcccaccctctcctgcagggccagtcagatgtgcncttganctgtacanacaactggccngctccagccctnatctatggtncactccaacacggggccacgtcgggctactccccgagcctaggttcaagtggcgtagtagggtatggggacaggactttcactctcactatcatcacgccgtggacgacctagaacgattgtgtctagtttattactgtacaatactcgtacgagtcggtccgtccggggtcctacgtttccggcccgtcgggacctagggtcgagtactacgtaaacgacgttaggtcggctgctaccatcttcgcttctaccg

SEQ ID NO: 262784 - DNA, 653 bp, Homo sapiens
  misc_feature: GYAE6OF01CXXZU.8.33.C11.1.454.CMB.1.raw
  modified_base (211)..(211): a, c, t, g, unknown or other
  misc_feature (211)..(211): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaancgcccaccctctcctgcgagggccagtcagaatggttgcgtccttcgagctggtaccaacacaaacctggccaggcctcccacggccccctnactctatggtgccatccaacgacgggccacgtggcactcccagccgaggttccagtcggctagggtgggtagtgggacgagacttcacttcnccgacctatcctatccacgtccgtagacgaccgtagaagtattggttcgtcttaagttttacttacgtcgtaactaactaccgttaccggtaaccggtacgttccggggtacccggttcccgggggtccctttaccggttcccggtacccgggtcgggtaacccgtagggtacggaacggtacgtaaaccgaaacgggtacttgggtcggtacctccgaccgtaccttacgttcctttaacggtccttacgttacccg

SEQ ID NO: 262785 - DNA, 709 bp, Homo sapiens
  misc_feature: GYAE6OF01EH7TA.8.33.C11.1.454.CMB.1.raw
  modified_base (162)..(162): a, c, t, g, unknown or other
  misc_feature (162)..(162): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (663)..(663): a, c, t, g, unknown or other
  misc_feature (663)..(663): n is a, c, g, or t
tcagctcgcgtgtccacgaccggtgctcgatttagagtgagctcgttgggtttgggggaggaactgctcagttaggacccgagagggaaccatggaagccccagctcgagcttctcttccgtcctgctactctggcctcccagtttcacgatacccaccggnacgattgtgttcgacacgaatcctccgacgcccacccgtgtccttcgtctaccgaaggggaacncgcccacctctacctgcgagggccagtcagatggttgccnctacgtactccgtaggtaaccaanacgaaccgtggccacggccctcccgaccggccccctagactcctagtcggtcgctactacccgaacgacgggaccctacgtcggacctacctcccgacgcccgtacggtttaccgaaggttcggccgtaagggttggggtaacggttacgggaactaacggtaccttaccgaccttccgttacccaacctactacctacttaccgaccggtcccggtagggaactccgtaaggacggtattgggttactacgtttagttttataccgtagtaccaactacgttccgtacgtcggtccggacccggttccggggcctttaccggttcccgaccggttacggacctaagggtctaacgtactaaccggaaacgtntacggtcggacttcgacccgtactacttcgtcgtttcctcgtaccc

SEQ ID NO: 262786 - DNA, 537 bp, Homo sapiens
  misc_feature: GYAE6OF01ECUO8.8.33.C11.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
  modified_base (397)..(397): a, c, t, g, unknown or other
  misc_feature (397)..(397): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcncttgaagctgtacaacacaactgccaggctccaggcccctnatctatggtgcatccaacgacgggccacgtcggcactccccagcccgtaggttccaggtcggcgaggtgggtatggggacaggtactcactctcaccatcatcagcctggacncctagaagtatgtgctagtttattactgtacaactactacgtacgtagtcggccgtccggggcctacgttccggcccgtcgggaccgtaggtgagacgtacgaacgtacgtggtcggctcgctacatctcgtctcgtacc

SEQ ID NO: 262787 - DNA, 783 bp, Homo sapiens
  misc_feature: GYAE6OF01C6VCC.8.33.C11.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaancgccaccctctcctgcagggccagtcagatgtgcgctacgtatcctaggtaccaacaagaacctggaccaggcctcccgacggcccctcatctatcggtnactactccaaacgacggggccaacgtgggaccaacgtccccgagaccgtaggtttccaaggtcggacaagggttaggggtactagggggacaaggtaccttacgaacctcctacaacccaatcctaatccgaacgtccgtacgggacgtacccgttaggaacggtagttacggtttacgaccgtttaaggttttttaaccttaaccggttacgttaacccgtaaaccgtacgtttaacccgggttaacccgggtacggggttaccggggttacccccgggttacccgggggggtacccctttaaccggttttaccccggggaccccggttaccgggggtaaaccccgtaaagggggttacgggaacggtaaacggttaaacccgtaaaaccgggtaaacgtttcgggtaccgggtaccttaacgggaccctacccgttaaacgttccgttaccgttcccgttaccgttaacccg

SEQ ID NO: 262788 - DNA, 558 bp, Homo sapiens
  misc_feature: GYAE6OF01DR8FL.8.33.C11.1.454.CMB.1.raw
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcncttcgaagctggtaccaacacaaacctggccaggctcccaggcccctnatctatggtgcatccaacgagggccacgtggcactcccagccagttcagtcggcgaggtgggtatgggacaggacttcgactctcacatcatcagcctggacncgtgaagtgtagtcgctagtttacttacgtntacaactatcgtacgagtcggcccggtccggggcctacgtttccggccgtacgggaccgtaagggtcggagtacgtaacgaaacgtacgtggtcgggctacgacctactactcgtcgtcttcgtaccg

SEQ ID NO: 262789 - DNA, 722 bp, Homo sapiens
  misc_feature: GYAE6OF01EA3CS.8.33.C11.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagtattgtgttgacacagtcctccagcccaccctgtctttgctccgaaggggaaagcgcccaccctctcctgcagggccagtcagatgtgcncttganctgacaacacaacngccagctccacgccctnatctagtggtcgcactaccaacgacgggccacgtcggacactccccgagtccgtaggttccaggttcggcgtagggttcgggtagtcggggaactaggtaccttcgacctccgtaccacctagttaccatccgtacggccgtacgggacgtccgtaaggtaaacgtacgttggtttacgtacgtttaagttttaacttaacgttacgttaacctaactacgttaccgggtaaccggtacgggttaccgggtcccgggttacccggggggtaccctttacccgggtttccccgggtaccccggttaccggggtaacccggtaaacggggttacgggtaaaccgtaaccgttaaccggtaaaaccggttacggtacggttacgggaccgttacggaacccgtaaccttacgttccgtttaccgttccgttactacccg

SEQ ID NO: 262790 - DNA, 1063 bp, Homo sapiens
  misc_feature: GYAE6OF01EWVNE.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagactaccgacggagagattgtgttgacacagtcctccagcccaccctgttctttgtctccgaggggaaagacgcccaccctctcctgcgagggcctagtcaagtaattggttcggccgtccgtttacggtaagcgttacggtaaccaaacaaccaaacctcggaccacggccctacccgacggccccctacactctagtggtcgcactacccgaaccgacgggtcccaacgtcgggacctactaccccgacgaccccggtaggtttcccgaagggttcggaccgtaaggggttaggggtacggtacggggactaacggtacctttaccgaaccgtttcctaacccgtaacccctaacttaccgtaaccttacccggtaaccggtacccccggttacggggtaacccgttaccccgggttaccgggtaaaaggttaaccggtttacgggtttaaccgggttaacccgtttttaaacggtttttaaacgttttaaacccggtttaaccggtttaaacccgttaaaacccgttaaccggtttaaccccgggttaaacccgggttaaccggggtttaccccggggggttacccccccggggtttaccccccgggggggggtttaaaccccgttttacccccgggggtttttaaccccccggggggttaccccccgggtttaaaccccgggggggtaaacccggggtttaaaaccgggggggtaaccgggggttaaacccggggtaaaaccggtttaaaaccccggggtaaaaaacccgggtttaaacccgggtttaaaccgggggttaccgggggttaacccccgttacccgggggttaaacccccttaaacccggttaaccggttttaacccccggttttaccggtttttaaaccccgtttcccggtttttaaaaccccccg

SEQ ID NO: 262791 - DNA, 657 bp, Homo sapiens
  misc_feature: GYAE6OF01CC5TK.8.33.C11.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctcgaggggaanacgccacctctcctgcagggccagtcagagtcgtacccacctagttacgcctaggtaccaacacaaaccgtggaccaggcctcccacggtcccctnattctttgatgcactccaacgacggccacgtcggacactcccgagccctaggttcaggtggctagggttggtagtcgggaacacggtactttcgaacctctaccacagtcatccgacgcctggacgtccgtagagggtacttgttcgtacttaaggttttacttacgttcgtacctaacgtacgttaccgtaaccggtggtaccgggtccgttcccgggggtaccttaccggttccgggtacccgtacgggtaaccgtaaggtcggtaacttaacgtaaccgaaaccgtaacgtcgggtacgacttacggccacccgtattccgttcttacttaccgtaacttcccgttacccggtacc

SEQ ID NO: 262792 - DNA, 637 bp, Homo sapiens
  misc_feature: GYAE6OF01A81AU.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgccagggccagtcagaatgttggcgccttgtaagctggtaccaacacaaacctggccaggcctcccaggcccctcatctatggtgcactaccaacagggccacgtggcactcccagccaggttcagtggcaggtgggtatgggacagacttcactctcaccatcatcagcctggacgtcctaggaagtagttggtttacgcttaagttttacttaccgttgtacctaaacgtactccggttaaccggtaggtccgggtccccggttacccggggggtacccttaaccggttttcccgggtaccccggttacggggaacccgtaaggggttacgggaacgtacgtaccgaaaaccggtacgtacggttcgggccgtacgaccgtaccctaagtcccgttagttccttcgtaccg

SEQ ID NO: 262793 - DNA, 649 bp, Homo sapiens
  misc_feature: GYAE6OF01EQ0FY.8.33.C11.1.454.CMB.1.raw
  modified_base (208)..(208): a, c, t, g, unknown or other
  misc_feature (208)..(208): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangcctaccctctcctgcagggtccagtcagaatgttggcaccttgtaagctaggtaccaacgacaaacctggccaggcctcccaggcccctnacgtctatggtcgcactccaacgacgggccacgtggcacgtcccagccgagttcagtcggcaggtggtaagngggtacaggtacttcactctacaccgtatcattcgactacccgtggacgtcccgtagaaagactagttacgtactaggtttaacttacgtatacaactacgttccgtacgtaacggtcggtcccgtacccgggggtacccttacggtttccgggaccccgttacggggaaccaacggggtacggtaacggtaactaaccggtaaacggtaacgttacgggttacggaccgtacggacccgtaaccggtaacttcccgtacggtttccttcgtaacccg

SEQ ID NO: 262794 - DNA, 566 bp, Homo sapiens
  misc_feature: GYAE6OF01B2FUX.8.33.C11.1.454.CMB.1.raw
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcactgggtccgccgaaactccaggcgaagggagttggaggtgggtggcgtaggttgtttacgatcgtggagggcagtgttacaagtgtatgctgacgccgtgaagggccgactcgacactctacagagacaacgtccaacgacacaatacgtagttacgtactagaacgacgacctaagtcctagaggacgacggtgtaactacgtactcgtacggaaggacgggggaacgacggcgggacgttacgaacgtacgtacgttagcggtcgtcgggtaccggg

SEQ ID NO: 262795 - DNA, 729 bp, Homo sapiens
  misc_feature: GYAE6OF01BHGPB.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgctccgaggggaaancgccaccctctcctgcagggccagtcagatgttgcncttgagctgacaacacaacctggcagctccagcccctnatctngtgctataccaacgacgggccacgtcggcacgtacccagccgacggttcacggtcggacgtaggtgggtacgtgggacgtagtaccttactaccgtcctaccgaaccctacgtccaactccgaacggtcccgttagggaccgtccgtaggaaacgtacgtttaggttacgtacgttaagttttaacgttaccgttaggttaccctaaacgttacgttacccggttaacccggtaacggttccggggtacccccggttcccgggggggtacccttacccgggtttacccgggtaccccggttacgggggtaaccggtaaaccgggttacgggaaacgtaaccgtttaacccggaaaacggttaacccgttacggggtcgggtacccgttacggaccgtaacccgttacgttaccgtttcgggttacccttccggttaacccc

SEQ ID NO: 262796 - DNA, 730 bp, Homo sapiens
  misc_feature: GYAE6OF01CEH34.8.33.C11.1.454.CMB.1.raw
  modified_base (210)..(210): a, c, t, g, unknown or other
  misc_feature (210)..(210): n is a, c, g, or t
  modified_base (374)..(374): a, c, t, g, unknown or other
  misc_feature (374)..(374): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccgacggagagtattgtgttgacacagtctccagcccaccctgtctttgtctccgagggaancgccacctctcctgcgaggccagtcagatgtgctcttagagctagaccaacacaacgtcggcaggcctaccgacgccctcatctagtggtcacactaccaacgcggtccacgtcgacctactcccgagccgtaggttcaggtcgcgagggttggtagtggaacngtaccttcgacttcgaccacgtatccgtataccgacggtccgttagggaccttaccgtaaggtaaacgttcgttaggtttcgtaccgtttaagttttaacttacgttacgttaccaaacgttacgttaacccggtaaccggtacggttaccccggggtaccccgggttaccccggggggttacccttaaccccggggtttccccgggtaccccgggttaccgggtaaaccgggtaacggggttaccggaaaccggtaaacctaaacccgggtaaaacgtacggttacgggtacggtacccgtaacgacccgtaaccgtacgtttaccggttacgtttcccgttacgttacccccgg

SEQ ID NO: 262797 - DNA, 818 bp, Homo sapiens
  misc_feature: GYAE6OF01DD80J.8.33.C11.1.454.CMB.1.raw
  modified_base (227)..(227): a, c, t, g, unknown or other
  misc_feature (227)..(227): n is a, c, g, or t
  modified_base (422)..(422): a, c, t, g, unknown or other
  misc_feature (422)..(422): n is a, c, g, or t
tcagctcgcgtgtccacgaccggtgctcgatttagagtgagctcggttgggtttgggggagaactgctcagttaggacccagagggaaccatggaacgccccagctcagcttctcttcctctgctactctggcctcctagtttcagactaccgacggagagtatttgtgttgacacagtctccacgcccacccttgttccttttggtcctaccggaaggggaaaacnccgccctaccctctcctagcgacgggtccagtcagtagtggtcggcgtcttacggtagcgtacggtaaccaacgaaccaaaccgtcggacccgacggtccctacccgacggtccccctataacttccgttaagtcgggtcactaactacccgaaacggcggcctacgcgcctaactcccgagaccggtaggttcnggttacggacggtagggttacggggtacgtcgggaactacgtacttaccacttccaccacctactctaactaccgacggtaccgtacggacgtaccgtaaaggtacgttaacgtttgggttcccttaaagttttagttttaaaccgttaccggtaagtttaaacccaaaccggtttaacggttaccgggttaacccggttacgggttcccggggtaccccggggttaccccgggggttaacctttacccgggggtttcccgaccccgggggtaagggtaaacccggttaagggtacccgggtaaaacgtacccgtaaaacggtaaacggtcggttacgggccgggttctacccgacttacccggttattaccgttcgtttaacccttcgtaccccg

SEQ ID NO: 262798 - DNA, 713 bp, Homo sapiens
  misc_feature: GYAE6OF01BABHH.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagcccaccctctcctgcagggccagtcagaatggttggcgccttcgtaagctggtaccaacacaaaccgtggccaggcctccgaggcccctcatctagtggtgctactccgaacgacgggcccacgtcggaccacgtccccgagtcccgaggttccaggtcggacgtagggtgggtaacgtggggaacacggtacttcgaccgttactaccaacctagtaccaacttccgaacggtcccgttagggaccgtcccgttaggtaacggtacgttggttcggtaccttaaggtttttaacttaccgtttagtaacctaaacgtacgttacccggtaaccggtacggtaccggggtccccggtacccgggggttacccttaccggtttcccgggacccgttacgggtaacccgtaaagggtcggaacgtaacgtaaccgtaaaaccggtacgttacggtcggaccgttacgacccgtactacgtaccttacggttccttccgtacccg

SEQ ID NO: 262799 - DNA, 1001 bp, Homo sapiens
  misc_feature: GYAE6OF01B7496.8.33.C11.1.454.CMB.1.raw
tcagctcgcgtgtccacgaccggtgctcgatttagagtgagctcggttggtttgggggaggaactgctcagttaggacccagagggaaccatggaagccccagctcagcttctcttcctcctgctactctggctcccagttcacgacgtaccgaccggagtagttagttgtgttagacctaccagtcctaccacgtcctacccttgttcgttttcgtcctaccggaaggggaaaacgacgcccaacccctcctccctgccgaacgggggccccaaggttccaaggtaaacgttcgggttttcgggcccggtacccgttttacccggttaaagggcccttacggggttaaaccccaaaaaccgaaaaccctaaaacccggtccggaacccgtaaccgggtcccctacccggaccggtccccccgttaccaacgtttccctaagttcgggtcgacctacttaccccgaaaaccgacgggggcccctaaccgtcgggaccctaaccgttcccccgaacggtacccgtaacggggttttccaacggggttcggaccgtaacggggttaggggtacgttacggggaacgtaacgtaccgttaccgtaccttaccttaccgtaaccctaacgtacctaacgtaccgaccgtaccggttacggggtaaccgtaccccgttaaggaaaccgttaagttttcgggttacgtacgtttttaaacgtttttaaccgttaaccgtttaccgtaaccgtaaaccgttaaccggtttacccgggtaacccggttaccgggttcccggggtaccccgggtttaccccgggggttacccttaaaccccgggtttttccccggggaaccccggttacgggggtaaaccccgttaacggggttaaccggtaaccggtaaaccgttaaaccggtaaaccggtaaaccggttacgggttcggtaccgtaccggtacccggtaaccctaacgttccgtttacgttcccgtttccttaacccg

SEQ ID NO: 262800 - DNA, 773 bp, Homo sapiens
  misc_feature: GYAE6OF01BZHJT.8.33.C11.1.454.CMB.1.raw
  modified_base (212)..(212): a, c, t, g, unknown or other
  misc_feature (212)..(212): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccagtttcagataccaccggagagattgtgttgacacagtctccacgccaccctgttctttgtcctccgagggaacncgcccaccctctcctgcgagggccagtcagtaagtgttggccgtccgttacgtagcgtacggtaaccaacaaccaaaccgtcggaccaggcctacccgaccggcccctcactactagtcggtcacgactaccgaacgtacgggacctacgtcgggacctacgttaccccgacgacccgtacgggtttaccgacggggtcggtacgtaacggggttaggggtaacggtacggggactaacgggtacctttaccgtacccgttacctacccgtaaacccttacgtaccgtaaacgttccgaaccgggtacccgttacggggaaccgtcccggttaaggtaaacgttagtttcggtttacgacgtttagttttaaccgttacgttacgtaacctaacgtacggttaccgtaacggtcggtaccgggtcccggtaccggggtccttaccggtttccggacccggtagggaaccgtagggacggtacgtacgtaaccggaaacgtacgtacggtcgacccgtacggaaccttaccggtattaccgttcgttacccttcgttacccg

SEQ ID NO: 262801 - DNA, 695 bp, Homo sapiens
  misc_feature: GYAE6OF01D052Z.8.33.C11.1.454.CMB.1.raw
  modified_base (207)..(207): a, c, t, g, unknown or other
  misc_feature (207)..(207): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtctttgtctccgaggggaanacgccaccctctcctgcagggccagtcagatgttggcgcttgagctgtaccaacacaacctggccagctccaggccctcatctatggtcgcactaccaacgacgggacccaacgtgggacctacgtccccaacggtcccgaaggtttcaaggtcggactaagggttggggaattcgggggaactaacgtacgttaccaccgttctaccaccaattccaatacctaacgcccgtagggactccgtaacgaagtacgtgtttacgacttagtttaactttacgtgtactaactacgttaccgtaaccggtcggtcgggtaccccggttcccggggggtaccttacccggtttccgggtcccggttacggggaaccggttaacgggtacgggtaacgtacgttaaaccggaaaacggtaaccggttagggtacgggttaccgtcggtaaccgtaccgtacttaccgttacgtttccgtttaacttaccccg

SEQ ID NO: 262802 - DNA, 557 bp, Homo sapiens
  misc_feature: GYAE6OF01D6ZFS.8.33.C11.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (353)..(353): a, c, t, g, unknown or other
  misc_feature (353)..(353): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagatgtgcncttcganctgacacacaactgcagctccagccctnatctatggtgcatccaacgacgggccactggcatcccagccaggttcagtgacagtggatggacagacttcactcncacatcatcacgctagagcctagaagactgttgctagtttattactgtacaatacgtcgtacgtaggtcggtccggtccggggtcctaccgttccgggcccgtacgggaccgtaagggtacggaacgaacgttaccgaaaacgtaacgttaggtcggtaccgtcggaccgtaccctacgttaccttcgttccgttccgttaccg

SEQ ID NO: 262803 - DNA, 640 bp, Homo sapiens
  misc_feature: GYAE6OF01BK3T6.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgagggaagacgccaccctctcctgcagggccagtcagatgtgcgcttcgagctgaccacacaactgccagctccgagccctcatctagtggtgacacgtaccgaacgacgggccacgtggaccacgtacccagccgtaggttcgacggtcggacgtaggtgggtagagggacacgtactcacgtctacactactcactcacgccgtaggacgtctaggaagtacgttgtacgtacgttagttttaacttacgttacgttaccgaaacgtacgttaccggtaccggtacggtcccgggtacccggtcccgggggtacccttaccggtttcccgggacccggtaggggaacccgtacgggtacggtaacgaacgtaaccgaaaccggttacgtcggtacggtccgtacgaccctacgtacttacgttcgttccgtcgtacccg

SEQ ID NO: 262804 - DNA, 744 bp, Homo sapiens
  misc_feature: GYAE6OF01CYU15.8.33.C11.1.454.CMB.1.raw
  modified_base (691)..(691): a, c, t, g, unknown or other
  misc_feature (691)..(691): n is a, c, g, or t
  modified_base (716)..(716): a, c, t, g, unknown or other
  misc_feature (716)..(716): n is a, c, g, or t
tcagctcgcgtgtccacgaccggtgctcgatttagagtgagctcgttggggtttgggggaggaactgctcagttaggacccagagggaaccatggaacgccccagctcagcttctcttcctcctgctactctggcctccctagtttcagactaccgacggagagtattgtgtgacacagtctccacgcctaccctgttctttcgtacctaccggaagggggaaacgacgccctaccctctccgtggcgacggggccaaggtacaaggtaagttcggttcggcgtaccgtttacggtaaagtccgttacgggtaaacccaaactaaccgaaaccgttcggaacctaacgggccctacccgaccgggtcccctacacttcgtaacgtggtacactaactaccgaaacgtacgggacctacgtacgggacctacgtaccccgacggaccgtaacgggttcgaaggttccggagtacggggttaggaacgtcgggaacacgtaccgtttacacttcgtaccacgtataccgtaatccgtacggtccgttagggacctccgtaaggaagtagttcgttaggacctttaggtttaaacctgtacgtaaccaattacgtaccgtacgggtagtccgggaccccggttccgggtaaccttccggttcgggacctagggaaccgtagggtacgacgtaanaaccgaacggttgacgtcgtaacgnacccgtagtacttgtactcgttctaccg

SEQ ID NO: 262805 - DNA, 977 bp, Homo sapiens
  misc_feature: GYAE6OF01EPMT1.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagactaccgacggagagtattggtgttagacacgagtctaccagtcccacccttgttcctttgtaccgtaccggaagggggaaaacgccgacccgtaccccttcctccgtcgacgacgggccctagtacgaaggtaagttggtccggccgtccgtttacggtaacgtacgttaccggtaaacccaaaccgaaacccgtaaaccggtcggacccgtaacgggtccctaccccgaccggtccccctacgtacttaccgtacgttcgggtcgtaccctaaccgtacccgaaaccgggaccgggaccctaccgtacggacccttaaccgtaccccgaacggtccgttaacgggttaccacgggtacggtaccggtaagggttacgggggtaacgtacgggactaacggttaaccttacaaccgttataccccgaaaccttactaccgtaacgtaccggtaaccgtaccgggttacgggtaaccgttaccggtaacggtaaacggttacgttttcggttaaccggttaaccgttttaaggttttaacctttaaccggtttacgttaaaaccgtaccgtttaacggtttacccggtaaaccggggttccgggtacccggggttacccccggggttacccggggggtaacccctttacccgggtttaccccgggtaccccgggttaaacggggtaaacccggttaggggtaaccggttaaaccgggtaaacccgtaaaccgggttaaaaccggtaacccgggttggttaccgggtaccttaaccgggaacccttaacccggtagtttacccgtttcgttaacccttccgttaaccccggg

SEQ ID NO: 262806 - DNA, 581 bp, Homo sapiens
  misc_feature: GYAE6OF01A5CDF.8.33.C11.1.454.CMB.1.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcaggccagtcagaatgtgcnccttgaagctgtaccaacacaaacctggccaggctcccaggccccctnatctatggtgcatccaacgagggcccacgtggcatcccagccaggttcagtggcaggtgggtatggggacagtacttcactctacaccatcatcacgcctgggacgcctagaagtagtgttgacttagtttacttacgtgtacaactatacgtaccgagtccggccggtccgggggtccctacggtttccggcccgtcgggaccgtaagggtcggacgacgtaccgaaacgtaacgtggtcggtacgtcgaccgtaacccgtactaccgttcgtaccttccgtacccg

SEQ ID NO: 262807 - DNA, 765 bp, Homo sapiens
  misc_feature: GYAE6OF01CXBA6.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgagggaaancgccaccctctcctgcgagggccagtcagaatggtcgcgtccttagtagctaggtaaccaacaacaaccgtggaccgacggcctcccgaccggcccctctactcgttagtcggtcgacctactacccgaaacgacggggcccacgtcggaccacgtccccgacgccgtacggttcgacggttcggaccgtaggggttacgggtaacgttcggggaactacgggtaacctttaccaccgtttcctaacccgaacctataccctattaccgacgtcccgtagggtaaccgtccgtaaggtaagtagtttcgttagtaacgtttagttttaactttaccgtgttaacctaaacgttaccggtttaccggaaccggttacgggttacccgggtcccgggttaccccgggggttaccctaaccgggttttcccggaccccgggttaggggaaccccgttaaaggggttacggaacgtaaccggtaaccggaaaccggttaaggttcggtcgggtacccttacggaccgtaacccgttattccgttcttcgtttacctacccg

SEQ ID NO: 262808 - DNA, 559 bp, Homo sapiens
  misc_feature: GYAE6OF01CML72.8.33.C11.1.454.CMB.1.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
tcagctcgcgtgtccacgaccggtgctcgatttagagtgagctcgttgggtttgggggaggaactgctcagttaggacccagagggaatcatggaagccccagctcagcttctcttcctactgctactctggctcccagtttcagataccaccggagagattgtgttgacacagtctccagccaccctgtctttgctccgagggaanagccaccctctcctgcaggccagtcagatgtggcgccttgaagctggtaccaacacaaacctggccaggctcccaggcccctnactctagtcggtgccatcccaacgcgggcccacgtggccactcccagcccaggttccagtggcaggtgggtangggaacagaccttcgactctaccacagtcatcacgctaggacgcctagaagtactgttgacttagtttattactgtacaacagttcgtaacgngtcggcccgtccggggcctacgttccggacccgtacgggaccgtaggtggaacgatacgaaacgtacgtggtacggtcacgaccacattccgtgtccttaccg

SEQ ID NO: 262809 - DNA, 602 bp, Homo sapiens
  misc_feature: GYAE6OF01EVTV1.8.33.C11.1.454.CMB.1.raw
  modified_base (171)..(171): a, c, t, g, unknown or other
  misc_feature (171)..(171): n is a, c, g, or t
  modified_base (257)..(257): a, c, t, g, unknown or other
  misc_feature (257)..(257): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (442)..(442): a, c, t, g, unknown or other
  misc_feature (442)..(442): n is a, c, g, or t
tcagctcgcgtgtccacgaccggtgctcgatttagagtgagctcggttgggtctgggagaggagcccagcactagtaagtcggcggtgtttccattcggtgatcagcactgaacacagaggactcaccatggagtttgggctgactgggttttcctgttgctcttttaagnggtgtccagtgtcaagtgcaactggtggagtcgtgggggagcgtagtccagcctggggagtcacgagagactctctgtgcagcctntggttcaccttcagtagctacggcatgcacgtcgggtccaccaactccgaggacaagggnttgggagtgggngntagtttgttcagttcgngagggcagttgttacaagttggtatggctggacgtcgtaggaacgggtccgtattcgacctatctaccgagtacgacaactcccgaagacccanaattgtagttcgactagaacagtacctagtccgtagtacggaaccttacgggtagtaactacgtaccgttggtaaccggaggggaaccggggtacgacggtacgggtacgttacccgaaaggtttaccctacgtttacggaccgttgccggggtaacccg

SEQ ID NO: 262810 - DNA, 588 bp, Homo sapiens
  misc_feature: GYAE6OF01DCXIQ.8.33.C11.1.454.CMB.1.raw
  modified_base (294)..(294): a, c, t, g, unknown or other
  misc_feature (294)..(294): n is a, c, g, or t
  modified_base (440)..(440): a, c, t, g, unknown or other
  misc_feature (440)..(440): n is a, c, g, or t
  modified_base (466)..(466): a, c, t, g, unknown or other
  misc_feature (466)..(466): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgtgacacagtctccagccaccctgtctttgtctcgagggaaagacgcccacctctcctgcgagggccagtcagatgtggctcttcgaagctagtaccaacacaaacctggaccagcctcccacggcccctnatctagtggtgcactccaacgacgggccacgtggcactcccagccgaggttacaggtggcgagggttgggtagtcggggaactaggtacttcgactcgtaccactatctatcgacgtcgtgggacgccgtagaacgtattcggttnacgttagttttatacttgtaccaatntaccgtacggagtcgggcccgtccggggtcctaccggtttcgcccgtaggaccgtaaggtggaacgtagaacgaaacggtatcggtggacgtcgactacctacttactcgttctcttacccg

SEQ ID NO: 262811 - DNA, 633 bp, Homo sapiens
  misc_feature: GYAE6OF01BBBPE.8.33.C11.1.454.CMB.1.raw
  modified_base (381)..(381): a, c, t, g, unknown or other
  misc_feature (381)..(381): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgccaccctctcctgcagggccagtcagaatgttggcgccttcgtaagctggtaccaacacaaacctggccaggctcccaggcccctcatctatggtgcatccaacagggccacgtcggcactcccagccaggttcaggtggcaggtgggtatgggacagacttcacttcncaccatcactcagcctggacgccgttggaggtacgtgttggacgtaggttttacttactgttacctaactactacgttaaccggaggttcgggtcccgttacccggggggtccctacccggttttcccgggcccgttacggggaacccgtaaaggttcggaaacgttaacgtaccgtaaaaccggtaacgtacggttcgggtaccgttacggacccgtaccctaacgttccttacggttccttaccgtaccg

SEQ ID NO: 262812 - DNA, 830 bp, Homo sapiens
  misc_feature: GYAE6OF01BM85M.8.33.C11.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagtgagctcgttgggtttggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagacgcccaccctctcctgtcgccggcagtcagagcgttaggacgtaacttgcctgtatcagcaggacggccgtggccacgggcctacccgagtacctccgtactacgtttcgtttcgggccgttacccgttttaaacggacggggtcccgtaaggtacgggtaacctccccgacggcccgttaacgggttcgaacgggtccgggtcgtaagggttcggggggttccgttacgggggttaacccttttccggtttaccctaacccgtttacccgtacccgtaaacccttaacgttaaaccctaaaaccgttaaaccccgttacggaaccttaaccgttaccgttacggtaaccgttacgtttttacggtacgttttaacgttttactttacgttaccggttactacggtcctaacgttcgtacggtaacgtaccggttaccggtacccgtttaccgtaccgggtttaccggggacgggtaaccggggtaaccgttaacgggtacggaacccgttaaaccggaaaccggtacgttacgggtaccggtacgtacggtaccctaaccgttgttacccgttacggttacctttaccctaccgttttacccgtccccgttacgtccgttaccgg

SEQ ID NO: 262813 - DNA, 807 bp, Homo sapiens
  misc_feature: GYAE6OF01B1YIB.8.33.C11.1.454.CMB.1.raw
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
tcagctcgcgtgtccacgaccggtgctcgatttagagtgagctcgttggggtttgggggaggaactgctcagttaggacccagagggaaccatggaagccccagctcagcttctcttcctctgctactctggcctcccagtttcagactaccaccggagagtattgtgttgacacagtcctccacgccctaccctgtctttgtctccgaaggggaaacncgccctaccctctcctgcgacgggccagtcagtaatggttcggcgtccgttacgtaagccgtacggtaacccaacaacctaaaccgtggaccacggtccctacccgaccggtccccctanacttctagtcggtacgacctaccgtaccgaacgaccgggaccaacgtcggacctacctccccgaacgtaccgtacggttacgacggtcggtacgtaggggttacgggttaggacgggactaacggtaccttaccgacttaccctaccaaccgtactacgtacttaccggaccggttacccgtagggaccgtaccggtaaaggtaacgttagttcggttccgtaacgtttagttttaactacgttacgaacctaacgtacgttaccgggtacgtacgggtccggtacccgggtacccgggttaccttacccgggtttcccggaacccggttacgggaaccggttacggggtacggtaaaccgtaaccggttaaacccgtaaacggggttaccttcggggtacgacccgttaccggtaccctaacccgtttacgtttccggtttaccgttcccgttacccgttacccggg

SEQ ID NO: 262814 - DNA, 748 bp, Homo sapiens
  misc_feature: GYAE6OF01BESAF.8.33.C11.1.454.CMB.1.raw
  modified_base (291)..(291): a, c, t, g, unknown or other
  misc_feature (291)..(291): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtggggagtcacagagacctctcctgtgcagcctcgtgggttccacctttcagtacgctacggnatcgctacgtcgggtcccaccaaactccgaggacgaagggtattgggaggttgggtagcgtaggtttgtttacagtcgtaggacggtctaggttgttacgaagttggtatcgtacgtcggaaccggtccggtaaggaacgggtcccgtaacgttacccaacccgtacttccgttacccgaaaggaacgtaaccgtaaaccgtacccgaacggaaacctaacgtaaacgttacgtttaacgtttacgggaacccttaaggaacctaacggtaacccgttaaacggtccgtaggtaacgggtaccgtaacggggttagttaacgttaaccgtaacgttacgggtaaacgggaacgggggaacgggggtaaacccgacggggtacgggtaaccgttacccggtaaacgtttacccgtttaccgtttacgggtaccggttccgggtccggggtaaccccgg

SEQ ID NO: 262815 - DNA, 682 bp, Homo sapiens
  misc_feature: GYAE6OF01C4LVC.8.33.C11.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaanacgcccaccctctcctgcagggccagtcagaatggttgaccgcttagagctggtaccaacaacaaccgtgccaggcctcccaggccccctanactctagtggtcgcactccaacgacggccacgtgacactcccagccgtaggttcgaaggtcggacgtacgggttaggggtaacgtggggaacctacggtaccgtttcaaccgttctaccacctagtccatcgacgcccgtaggacgtaccgtagaagtatgttgtacgttagttttacttacgtgtactaactacgttaccgtacggtacggtaccgggtcccggtccgggggtacccttaccggtttcccgggcccgttacggggaaccgtaagggtacggtaacggtaaccgtaaccgtaaaacggtaacggttcgggtcgggttcccgttacgcccgtaaccgttacgttactttccggttcccttaaccgttacccg

SEQ ID NO: 262816 - DNA, 777 bp, Homo sapiens
  misc_feature: GYAE6OF01ACRDV.8.33.C11.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaangccaccctctccngcagggccngtcagatgttcggcnccttgaagctggtaccacacaacctgccaggcctccagcccctnatctactggtcncactccaacgcgggaccacgtggcactcccgaagcccgtaaggttccaggtcggactagggtgggtaactcggggaactacggtactttaccgaccttcgacccaacctagttaccaacgtccgtaaccggtcccgttacggggacgtacccggttaaggaaacggttacgttacggtttacggtaccgtttaacggtttttaacgttacccgtacgttaacccgtaaacgtacgtttacccgggttaaacccgggtacgggttacccgggtacccccggtttcccggggggttaacccttaccccggtttttacccggggacccccggttaacggggtaaccccgggttaaaacggggtcgggtaaaccgtaaacccggttaacccggtaaaacgggttaacccggttgggtaccggtacccgttacggacccgtaaacccgttacttacgtttcgtttacccttcggttaacccc

SEQ ID NO: 262817 - DNA, 817 bp, Homo sapiens
  misc_feature: GYAE6OF01B1UWA.8.33.C11.1.454.CMB.1.raw
  modified_base (217)..(217): a, c, t, g, unknown or other
  misc_feature (217)..(217): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccagtttcagataccaccggagagattgtgttgacacagtctccacgccctacccttgttctttgtctaccgaaggggaaancgcccaccctctcctgcgagggccagtcaagtatggttggcgtccgttagaagcgtcggtaacccaacgaaccaaaccgtcggaccaacggccctacccgacggtccccctctactcgtacgtcggtgacctaactacccgaaacgacgggccctacgtggacctacgtccccgagccgtaggttcaagggtcgacgtagggttgggtagtacgggaacgtaacggtaccttacgaccttcctaaccgtaaccattaccgaacttccggaaccggtaccggtagggtaaccgtaccgttaaggaaacgttacgtttacggttacggttaacgtttaaacggttttttaacgtaaccgtttacgtaaacccgtaaaacgttcgggtttaaacccgggttaccggtaacggggtttccccgggttacccccggggtacccgggggttacccctttaccgggtttccccggggaacccggttacgggggaacccgttaagggggttacgaaacgtacccgtaaacggtaaaccggtagttccgggtagtacccgtaacgaccctaacggttaacttcccgtttacgttcccgtttcgtacccg

SEQ ID NO: 262818 - DNA, 571 bp, Homo sapiens
  misc_feature: GYAE6OF01B4JG9.8.33.C11.1.454.CMB.1.raw
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (473)..(473): a, c, t, g, unknown or other
  misc_feature (473)..(473): n is a, c, g, or t
  modified_base (556)..(556): a, c, t, g, unknown or other
  misc_feature (556)..(556): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagaatgttgcgccttcgaanctggtaccaacacaaacctgccaggctcccaggcccctcactctatggtcncatcccaacgagggcccaacgtggccacgtccccacggccagggttcacggtggccgaggtggggtaactggggacagtaccttcgcctctcacctntccatcacgcctgganccctagaagtatcgttagcgtagttttatactcgtactaacagttcgtaaccgngtccggcccgtccggggtcctaccgtttcggcccgtcggacgtagggtgacgcgtaccgaaacgtagtcggtgctagctacgntacctgtcctgtacc

SEQ ID NO: 262819 - DNA, 714 bp, Homo sapiens
  misc_feature: GYAE6OF01DKHK8.8.33.C11.1.454.CMB.1.raw
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
  modified_base (340)..(340): a, c, t, g, unknown or other
  misc_feature (340)..(340): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccagtggagtttgggctgaacttgggttttcctcgttgcttcttttaagaggtgtccagtgtcaagtgactaacgtgggnggagtcggtgggggagtcgtagtccagccgtggggagtcacagacgactctcctgcgcacgccttcgtcggttcaccttnagtacgctacggcagtgcctacgtcgggccaccaaacgtccgaaggacgaagggtnttgggaggttgggtgcgtagtttcgttacagttcgtaggacgggtctaggttgttacaaggttggtaactcggtactcgggaccggtcggttaagggaacgggtccgtacttaccgaacctacgtaccgtaccgaagtaacgtaaaccctaacgtaccgaacgaacctaacgtaagttacgttaacgttacggaaccttacggaaacgtacgtaaccgtaacgtccgtaggtaaccggacgtacgggttataacgttacgtacggtacggtaacgggaacggggtaacgggggaaccgagggtaccgggttaacgttaccggtaaacgttccgtttaccgttacggtaccggttccgggtacggggtaccccgg

SEQ ID NO: 262820 - DNA, 619 bp, Homo sapiens
  misc_feature: GYAE6OF01B1347.8.33.C11.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagtattggtgttgacacagtctccagccacctgtctttgctcgaggggaaanagcccacctctccngcgagggccaggtcagaatgtggcgtccttgtaagctgaccaacacaaactgcaggctccaggcccctnatctatggtgcactccaacagggaccactggcactcccgagccgaggtctaggtggcaggtgggtatgggacagacttcactctacacctatcatcgagaccgtgggacgcctaggaacgtagttgttagacttagtttaacttacgtagtactaacgtataccgtaaccggtacggttcgggtcccggtacccgggggtcctacccggtttcccgggtacccgtacggggtacccgtaagggtacgggaaccgtaacgtaaccgaaacggtacgtacggtcggccgtagaccctaccgtacttccggttcgttccgttcgtacccg

SEQ ID NO: 262821 - DNA, 705 bp, Homo sapiens
  misc_feature: GYAE6OF01B4OI4.8.33.C11.1.454.CMB.1.raw
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagctcgcgtgtccacgaccggtgctcgatttagagtgagctcgttgggtctgggagaggagcccagcacgtagaagtcggcggttgtttccattcggtgatcagcactgaacacagaggactcaccagtggagtttgggctgtaacgttgggttttcctcggttgtcttacgttttaaggaggttcgtcctaagttgtacaaggtcgactaacgttgggtggagtcggtggggggagtcgtagtccaggccgtggggagtcacgagacgaccttctccgtgagccacggtccttcgttgggttcctaccgtttcgagtacgcctacggcagtcgctacgtcgggtacccaccaaacgtccgaggacgaagggtcttgggaggtgggtgacttaggttgttcagtcgtggaggctagttcgttanagttggtancgtcgtacggacgtcggtaggaaccgggtcctaattccgacctctctacgaagaactacaactacgaacgaactaacgtatagttacgttacgactaacgaacgtacgtaccgtaaggtccgtaggaacggtaccggtacggttataacgttaaccgtacgtacgggtaaacgggaacggggtaacggggtaaccagggtacgggtaaccgttaaccgtaaacggttaccgttacggttaggaccggttcggggacccggggtaacccgg

SEQ ID NO: 262822 - DNA, 840 bp, Homo sapiens
  misc_feature: GYAE6OF01ECHD0.8.33.C11.1.454.CMB.1.raw
  modified_base (214)..(214): a, c, t, g, unknown or other
  misc_feature (214)..(214): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccgaccggagagtattgtgttgacacagtcctccagcccaccctgtctttgtctccgaaggggaancgccaccctctcctgcgaggccagtcagtagtgttcggcgtccttgaagctaggtaaccaaccaacaaaccgtcggaccacggcctacccgacggccccctacactcgtagtgggtcgcctaacgtacccaacggaccgggccctacggtcggaccacctcccgacgtacccgtagggttccgaggtcggacgtaggggttcggggtaagtcggggaactaacggtacctttaccgtacccttaccgtaccctaacctaacgttacctaacgtaccgtaaccggtacccggtaggggtaccgtaccggtttaaaggaacgttagtttcgggtttacgtaacgttttaacggtttttacttaaccgtacggttaaccctaaacgtttaccggttacccgggttaaccgggttaacgggttccccgggtaccccggggttaccccgggggttaccctttaacccggggttccccggggtaccccggttaccggggtaaccggtaaacggggttcgggaaacgttaaaccggtaacccggtaaaaccggtttacggtaccgggtaccggtaccttaccggaccttaacccgttacgttacccggttttgttcccgttaccgttaccccg

SEQ ID NO: 262823 - DNA, 676 bp, Homo sapiens
  misc_feature: GYAE6OF01B58JB.8.33.C11.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (500)..(500): a, c, t, g, unknown or other
  misc_feature (500)..(500): n is a, c, g, or t
  modified_base (541)..(541): a, c, t, g, unknown or other
  misc_feature (541)..(541): n is a, c, g, or t
  modified_base (641)..(641): a, c, t, g, unknown or other
  misc_feature (641)..(641): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtcctccagcccaccctgttcctttgtcctaccgaaggggaagacgcccacctctcctgcgaggccagtcaagtaatggttcggcctccgttagtaacgcgtacgtaaccaaacaaccaaaccgtggaccagggccctacccgaccggtccccctanacttctagtggtnacctacaccgaagcgggaccacgtggaccactcccgagccgtaaggttccgaaggcggacgtagggtacggggtagtacgggactagtaccttcgaactcctaacactactactactcacgtccgtaggacgtacttaggaagttacgttggttanacttagtttaatacggtataacctaagtctaccgtaacggnggttacggaccccggtccggggtaccttaccggttccggccggtaacgggaaccgttaggaggaaacgacgtaacgaaacggtacggttggaccggttcncggtaacccagttactccgtacgttcctccttacg

SEQ ID NO: 262824 - DNA, 786 bp, Homo sapiens
  misc_feature: GYAE6OF01BIRTS.8.33.C11.1.454.CMB.1.raw
  modified_base (604)..(604): a, c, t, g, unknown or other
  misc_feature (604)..(604): n is a, c, g, or t
  modified_base (743)..(743): a, c, t, g, unknown or other
  misc_feature (743)..(743): n is a, c, g, or t
tcagctcgcgtgtccacgaccggtgctcgatttagagtgagctcgttgggtttgggggaggaactgctcagttaggacccagagggaaccatggaagccccagctcagcttcctcttcctctgctactcgtcggcctccctagtttcagtactaccgaccggagagtattgtgttagacactagtcctccacgcccctacccgttgtttccttttcgtcctaccgggaaagggggaaaacgccgacccctaccccttccttcccgtggaccggacggggccctagtaccgaaaggtaacgttgggttccggcccgttccgtttacggtaaacggtcgttaaccggtaaacccaaaccaacccgtaaaaccgtcggacccgacggtccctacccggaccggtccccctacgtacttcctagtgggtcactactaccgaacggaccgggtccaacgtcggacctacctcccgacgtaccgtaggttcgaggtcggacgtagggttacggggtacggtcggggaaactacggttaccttaccgtaccttccctaccaacccgtactacacgtaccacggtcccgtagggactccggtaggaaggttnttggtactagtttacttttactcgtactacaactacgttaccgacggtcggtccggtcccgggtccgggtaccttccggttcccggaccgtacgggaaccgtaggtcgtaacgtaccgtaacgaacggtatcggggtcnccgtacacccgttaactcgttaccgttcttccgtaccttcccg

SEQ ID NO: 262825 - DNA, 806 bp, Homo sapiens
  misc_feature: GYAE6OF01BGSVM.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaacgcgccaccctctcctgcaggccagtcagaatgtggcgcctacgtactccgtaggtaccaacgaacgaaaccgtcggaccgaacgggcctccccgaacggtcccccctacgtaacttccgttaacgtcgggtcgacctaacgtaccccgaaacggtacgggaccctacggtacggacctaacccgttccccgaacgtacccgtaagggtttccgaagggttcggacgtaaggggttggggtaacgtacggggtacctaacggttaaccgttcctaaaccttcccgttaaccaaaccctacgttacctaacgttaccgtaaccggtcccggtaggggtacccgttacccggttagggaagggttacgtttcgggtttacgtacgttttaaaggtttttaaccttaacgtttaccggtaactaaaccgttcgttaacccgggtacgggtacggttaccggtccccgggtaccgggggtacccttaccgggttttcccgggacccgttacggggaaaccttaagggtcgtaattaacgtaacgaaaccgtagtcgggtggtcctacggaccctacgtacgttctcgttaccgttctaacccg

SEQ ID NO: 262826 - DNA, 733 bp, Homo sapiens
  misc_feature: GYAE6OF01BPATA.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccacggagagattgtgttgacacagtcctccagccaccctgtctttgtctacgaagggaanacgcccaccctctcctgcgagggccagtcagagttgtggcgtcgttacgtagcgtacggtaccaacaacaaccgtcggaccacggtcctcccgacggccccctacactctagtgtcgctactaccgaacgacggccacgtggaccactcccgagccgtagttcgaggtcggacgtagggtggtagtcggaactacgtaccttccgtactcgtaacctaccgaactcctaacgttcgaacggtccgtagggacgtccgtaaggaacgttgttacggttacgacgtttaagttttacgttacgttcttaacctaacgtcgtttaacccggtacgtagggttcccgggacccgggttcccggggtaccctttacccgggttacccgggtaccccggtaggggtaaccccggtaaggggtaccgggtaaacggtaaccgttaaacccggaaaccggttacgtgggtaccggttaccgtaaccgggcctaaccgttagttcccgttagttccccgtttaccgtacccg

SEQ ID NO: 262827 - DNA, 657 bp, Homo sapiens
  misc_feature: GYAE6OF01CMPHH.8.33.C11.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcaggaccagtcagaatgttgcgtccttcgtaagctggtaccaacaacaaacctggccacggcctcccacggccccctnatcctagtggtcgcactacccgaacgacgggcccaacgtcggccactccccgagccgtaggttccaggttcggacgtagggttacggggtagtcggggaactagtacctttccacgttctccgaaccactccaatccaacgtcccgtaggacgaccgttagaacgtagttgttgacgttagttttacttacgtgtacctaacgtacttaccgtaccggtaggtaccgggtcccggtacccgggggtccttacccggtttcccggcccggttacgggaacccggtagggtacggacgacgtaacgaaacgtacgtcggttcggactcgacgtacctactctacgttccttgtacccg

SEQ ID NO: 262828 - DNA, 836 bp, Homo sapiens
  misc_feature: GYAE6OF01DH31V.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcctagtttcagactaccaccggagagattgtgttgacacagtcctccagcccaccctgtctttgtctccgaggggaaacacgcccaccctctcctgcgacgggccagtcagaatggttcggccgtccttacggtaagtcgtacggtaaccaaacaaccgaaaccgtcggacccaacgggtccctaccccggaaccggcccccttacacttaccgttaggtcgggtacacctacgtacccaaacggccggggaccctacggtcggtaccaccgttacccgacgtaccgtacgggttaccagggttcggacgtaggggttacgggtagtacgggaacacggtacccttacgaccttcctaccctactactacctacgttaccgaccggttacccggtagggacgtaacccggtaggtaaacggttgtttagggttaccgttaacgttaaggttttttaacctaaccgttacgttaaccctaacgttaacgttacccgggttaaccggtcggtacccgggggttaccccgggttacccggggggtaccctttacccgggttttcccgggacccgggttaccggggaaccggttaaggggtccgaaaccggtacgtaaacccggtaaaacggtcgggttacggtaccgggtacctaccgaacccgtaaccttacgttccggtttcttaccgttcccgttaaccccg

SEQ ID NO: 262829 - DNA, 687 bp, Homo sapiens
  misc_feature: GYAE6OF01A7PP6.8.33.C11.1.454.CMB.1.raw
  modified_base (206)..(206): a, c, t, g, unknown or other
  misc_feature (206)..(206): n is a, c, g, or t
tcagctcgcgtgtccacgaccggtgctcgatttagagtgagctcgttggggtttgggggaggaactgctcagttaggacccagacgggaaccatggaagcccctagctcagcttctcttcctcctgctactctggctcccagtttcagataccaccggagagattgtgttgacacagtctcagccacctgtcttgctcagggaaangccacctctccgtgcaggccagtcaggatggtcggctccttcgtaagctacgtaccaacacaaacctggaccaggcctccgacggcccctacatcgtacgtcgggtgcctacgtaccgaacggtcgggaccacggtggaccactcccagaccgtaggttcaggtggacgtagggtggtagtcggggactacggtaccttcactctaccgaaccctataccgattaccacggtacccgtagggaaccgaccttagaaacggtacgtcggttacgacgtttacgttttaacttactaacggttacctaacgtacgtaccggtaccggagtaccgggtacccgggtacccgggggtaaccttaccgggtttaccggcccggtacgggtaaacccgtagggtacgggtaaaccgtaacgtaaccggaaaacgtacggtcggtacgggccgtacgacctacgtcgttacgtcgtccttcgtacccg

SEQ ID NO: 262830 - DNA, 755 bp, Homo sapiens
  misc_feature: GYAE6OF01BHSYE.8.33.C11.1.454.CMB.1.raw
  modified_base (259)..(259): a, c, t, g, unknown or other
  misc_feature (259)..(259): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtagtccagcctggggagtcacagagactctcctgngcagccctctggggtttccaccttctagtaagcgtacggccgagtcgtcgacgttcgggtccggaccctaaaccgtaccgacggacggaacgggtaaggttgggtaggtggggtcgggtcgtaggtttgttttcgtagtccgtggtaggggcgtagttggtttaccgtaagttaggtaggttgcgtggtaccggccggttgggaaggggtacccggtacgttacctacccgacttcccttacccgaacgtaacgaaccgtaaacccttacccgaacggtaaaccaactaaacgtagtttaacgtttacggtacccgtacgaacgtaacgtaccgttaacgtacccgttaggtacggaacggtacgggttacgttaataaccgttacgtaacggtaacgggtaacggggaacggggggaacccggacgggtaaccggggtacggttaccgtaaccggttaccgttaccggtttacgtacgggttccggtacccgggg

SEQ ID NO: 262831 - DNA, 836 bp, Homo sapiens
  misc_feature: GYAE6OF01BGCHB.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggcctccctagtttcagactaccaccggagagtattgtgttgacacagtcctccacgccctacccttgttctttcgtcctaccggaaggggaaacgacgccctaccctctcctggacgacgggccagtcaagtaagttcggttcggccgtccgttacggtaacggccgttacggtaacccaaaccgaaacctaaaccgtcgggaccacggtccctacccgaccggtccccctacgtaacttcgtacgttcgggtcacctaactaccgaaacggacgggaccctacggtcggacctacctacccgaagtccgtaagggttctagggtcggacgtagggtaggggttacgtacggggaacctaggtaccttacgtaccttccgtaacctaacctacttaccgtaacttaccgaacggtaccgtacgggtaacgtaccgtaaggaagttacgttcggtttacgtacgtttaaacgttttacttaccgtactaaccgtaacgttaacgttacccgggtaacggtccgggtacccggggttaccccgggtacccgggggttacccctttaccggggttacccgggtacccgggttacgggaaccggttagggacgggtaaccgtaaccgtaaacggtaacgtaccgggtaggtcccgggacctacggtaccctaccgttagttccggtttacttcccgttaacgttacccg

SEQ ID NO: 262832 - DNA, 676 bp, Homo sapiens
  misc_feature: GYAE6OF01E3IDY.8.33.C11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaancgccacctctcctgcaggccagtcagatgttggcnccttgagctgtacacacaacctgccagcctccacgccctnatctagtggtcncactccaacgcgggccacgtcggcactcccagccgtaggttcaggtgcgtaggtgggtatgggacagtactcactctacactatcatcacgtccgtaggacgtcgtaggtaaacgtgttcggttacgtacgtttaaggttttaacttacgttacggtaacctaacgttaacgttacccgggtaaccggtacggttcccggggtacccccgggttacccgggggtacccctttaaccggggtttccccggacccgggttaaccgggggaacccgttaaagggggtacggaacgtaaacgttaaccggaaaaacggttaccgttcggggtacggacctcggaacccgtacctagttcccgttcgttaccgtccgttaacccg

SEQ ID NO: 262833 - DNA, 854 bp, Homo sapiens
  misc_feature: GYAE6OF01B1C04.8.33.C11.1.454.CMB.1.raw
  modified_base (837)..(837): a, c, t, g, unknown or other
  misc_feature (837)..(837): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagactacccgaccgggaagtaaattgtgttagacactagtcctccagcccacccttgttcctttcgcctaccgaggggaaaacgcgccctacccctcgtccgtagcgacgggcctagttcgttagtgttacgacctaacgttacgccgtaggtaacccaaacgtaacggaaacccttgggacccgagggtccctacccgacggtcccttaccctcacttcctacgttagaactaccacgtacccgaaacggtaccgggccctacgtcggaccacgtcccgaggtcccgtagggttcaggtcggtcgtagggtcggtcgtacggggacctaagtccttacacccgttccgactaaccgtgttacgaacgccgaacgtaccgttaacgaccgttacgtaacggttaaacggtttcttttaccggaaccttttaacgttttaacttaccggtcgttaccgtaacgtacggtaacgttaacccggttaacggtttaacccggttccgtttccccgttttaacggttacccgtttacccccgggaccggttaacggggtaaaccctaaaggggttcctaaacgttacccgtaacgtaaaaccggggttaccttacggggtcggttaacccgtacgaccccgttaaaccgtacgtttcccgttaccgtttacccgttaaccttcccgtttacccccggttacccncccgtacgttacccggg

SEQ ID NO: 262834 - DNA, 716 bp, Homo sapiens
  misc_feature: GYAE6OF01BNGTD.8.33.C11.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccacctctcctgcagggccagtcagatgtgcncttcgagctggtacaacacaactgccaggcctccgaggcccctcactctatcggtgcatccaaacgacgggcccacgtggcactcccgagccaggtttccaggttcggctagggtcgggtataggggaccaggtacttccaacttccgtacaaccctagttaccacgttaccacggacccttacgggacgtacccgttaggaaacggtaacgttacggttacgaccgttaaggtttttaacttaccgtttacggttacctaaacgtaacgttacccggttaacggtaacgggtttccggggtaccccggttacccggggggtccccgttaccgggtttttaccccggggaccccggtttacggggtaacccgtaaacggggtcggtaaacggtaccgtaaccgtaaaacggtacgtacgggtaacggccgtacgaccgtaaccgtaagttcctacgttcgttaccgtaacccg

SEQ ID NO: 262835 - DNA, 971 bp, Homo sapiens
  misc_feature: GYAE6OF01BFUEG.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggactcaccatgggagtttgggctgaactgggttttcctcgttgcttcttttaagaggtgtccagtgtcaagtgcaacgtggtggagtcgtgggggaggcgtagtccagccgtgggagtcacgagagacctctccgtgtcgcagtcccttcgttggggttcctacccttcgaaggttacgccgttaacgggcaagttcgacctacggttcggggtaccccgaccctaaaaccgtcccggaacgggaccgaaagggggtagttaggggtaacgggttgggggtcgggtaccgttaaggtttttcggttttacgaacgtttccggtgggtaacgggggtaccgtaaggtttcggtttaacgtaaagttgggttaactcgggtcgttacggaacccggtacccgggtaaggggtaaaccgggggtacccgttaaccgtttacccgtaaccccgttaaccgtttacccgttaaccccggtaaacggtaaacccgtaaacccgtaaacccgttaaccccggaaaaccgggtaaaacccgtaaaccgttaaaacgtttaacggtttaacggttttaacccgggtaacccgttaacggtaaacccgtaacgggttaaccccgttaaacggttacccggttaacgggtaaccggggtaaccggtaccggggtttaacggttaaacgttaaacccgtttaaacccggttaacggggttaaaccggggaaaacggggggtaacgggggggtaaacccggtaacgggggtaaccggggttaaaccgtttacccgggtaaaccgggttacccggtttaccggtttaccgggtaacccggttcgggttaaccccgggggg

SEQ ID NO: 262836 - DNA, 761 bp, Homo sapiens
  misc_feature: GYAE6OF01AH498.8.33.C11.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaangccacctctcctgcaggccagtcagatgttgcgccttcgtaagctaggtaccaacacaaaccgtggccaggctcccgaggcccctnactctatggtcgcactcccgaacgcgggacccacgtcggaccacgtcccccgagtacccgtagggtttccaaggttcgggccgtaaggggttggggtaacgttacgggggaactacgggtaaccttttccgaccgttaccgttaccaacccgtaagtttccaacgtttacccgacgtcccggttacgggaacgtacccgttaggaaacggtactttcgggtttacgtacgtttaagttttacgttaaccgtagttaacctaacgtacgttacccgttaaccggtaggttccgggtacccggttcccgggggtacccttacccggtttcccgggaccccggttacggggtaacccgtaggggttacgggaacgtaacggttaaccgtaaaccggtaacgttcgggtaccggtaccgttaccggaccgtaacccgtacttaccgttacgttccgtttccgttaccg

SEQ ID NO: 262837 - DNA, 768 bp, Homo sapiens
  misc_feature: GYAE6OF01CN96Q.8.33.C11.1.454.CMB.1.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
tcagctcgcgtgtccacgaccggtgctcgatttagagtgagctcggttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgcccaccctctcctgcacgggccagtcagaatggttggcgtccgttacgaagctaggtaaccaacacaaaccgtggaccaggcctccgacggccccctnactctagtggtcacactaccaacgacggccacgtcggacactccccgagaccgtacggttcgaggtcggacgtagggtgggtaacgtcgggaactaacggtacctttaccgaccctttctaccctaaccgtataccgacttacgaccgtccgttacgggaaccgtaccgttaaagaacgtagttcggttacgtaacgttaacggttttaacttacgtcgtaacctaaacgtcgtttaaccgaccgggtacgtccggggtaccccgggtcccggggggtacctttacccgggtttaccccgggtacccgggttacgggaaaccccggttaaggggtaccggtaaccgtaaacgttaacccgggaaaacggttaccggttacgggtacgggtacccgtaggtaacccgttaaccccgttaggtttcccgtttaccggttacctttcccgttaacccccg

SEQ ID NO: 262838 - DNA, 667 bp, Homo sapiens
  misc_feature: GYAE6OF01DW871.8.33.C11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaaanagccacctctcctgcagggccagtcagatgttgcncttgtaanctgtacaacacaaacctgccaggctccacggcccctnatctatggtgcatccaacgacgggtccagtggcactcccgagccaggttcagtcggcaggtcgggtatgggacacggtacttcactctacacctatacatcagtccgtaggcgccgtggacggtaattggttcgtacttaagttttaacgtttacttaggttactaaacgtacgttaccggttaccgtaacgggttccgggtacccggttacccgggggggtacccttaacccggttttccggggaccccggttacggggtaaaccgtaaacgggttacgggtaaacttaaccgtaaccggtaaaaccggtaacgttagggtaccgggtacctcggaaccgtacccgtaattccgtttacgttccgttccgttaaccc

SEQ ID NO: 262839 - DNA, 542 bp, Homo sapiens
  misc_feature: GYAE6OF01AKIRU.8.33.C11.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgcttganctgtaccaacacaacctggccaggctccaggcccctnatctatggtgcatccaacagggccacgtggcactcccagccaggttcagtggcaggtgggtatggggacaggtacttcactctacaccatcatcagcctggacgcctagagatgttgctagtttactacgtgtacctaactatccgtacgtgtcggccgtcccgggggtacctaccgttccggccgtcggaaccgtaggtcggagactacgaaacgacgttaggtcgcgtcgacgtactatctcgtcttctacg

SEQ ID NO: 262840 - DNA, 907 bp, Homo sapiens
  misc_feature: GYAE6OF01ASTCC.8.33.C11.1.454.CMB.1.raw
  modified_base (193)..(193): a, c, t, g, unknown or other
  misc_feature (193)..(193): n is a, c, g, or t
  modified_base (555)..(555): a, c, t, g, unknown or other
  misc_feature (555)..(555): n is a, c, g, or t
tcagctcgcgtgtccacgaccggtgctcgatttagagtgagctcgttgggtttgggggaggaactgctcagttaggacccagaggaaccatggaagccccagctcagcttctcttcctcctgctactctggcctcccagttctacataccaccggagagtacttgttgttacgcacagttctcctacgacccnccttacgttctttgtccgtccgaacggggaaagacgtcccacccttcccttcctcggtccgacggggtaccacgtacgtaactaacggttcgttcgggtcccgtccttttaaccggtaaggaccggttcggtttaaacccgaaacccgtaaaccttaaacccggttaaccgggccgaccgggtaccccgtttccgaacccgggtaccccctccttataccgtttacgtcggtccgactaacctaccgaaacccggacgggaccgaccgttttacgggcctaacctaccccgtaccggactaccgggtttacgacggtacggcgtaaaggggttcgggtacggtacggtaccggaactttacnccgtttaaccgcccttaaacgccgaactaccgggaattaccgacgtaccggttcggaccgtacgtacgtaaacggtattacggtcgtacgttacgttttaagttaccgttaaccgtcgtaaaccttacggtcccgtttaaccgggtcgttacccggggtaccgggtccccggggttaacccggttccgtttccccgggggtacccgttacggggtaacccggtaaaccgggttggggtaaacccgttacggttaaaccccgtaacgggtaaaccgggtttcggtaccgggtaccggttcccaacggttacccgaacggtttaccgtttcgggttacccgtttaactacccgg

SEQ ID NO: 262841 - DNA, 912 bp, Homo sapiens
  misc_feature: GYAE6OF01C98ZL.8.33.C11.1.454.CMB.1.raw
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
tcagctcgcgtgtccacgaccggtgctcgatttagagtgagctcgtgggagaggagcccagccactagaagtcggcggtgtttccattcggtgatcagcactgaacacagaggacctcaccatggagtttgggctgaacttgggttttcctcgttgcttnttttaagnggtgtccagtgtcaagtgcaacgtggtggagtcgtgggggagcgtagtccagccgtgggagtcacagagactctcctgtgcagtccttcgtgggttacaccctttacgaagtacgtacctaacggcaagtcgacctaaccggtcgggtaccccgaacctaaaaccgtcccgaagggaccgtaaaggggtagtttcggggaacgggtttgggggtacggtacgtttaaggtttcgtttaccaggttccgtaggacgggtctaggtttcgttagaaggttggtagttcggcgttacgggaccggtacggtaggtaacgggtacccgttacttacccgaacttaccgtacccgtacccgaaggaacccgtaaccctaaacccgtaccgaaaacgggtaaccaaacccggttaaagtttacggttttaacgtttaacccgggaacccgttaaagaaacccgttaacgggttacccgttaaaaccggttccggttaacgggaaacgggttaccgggtaaccgggtttaacgtttaaaccttccccggttaaacggttaccggggtaaaacggggtaacccggggggggtaaacggggggtaaacccggtaaccgggggtaacggggtttaaacccggtttaaaccccgggttaaacgggttttacccgttttaccccggtttaaacggggtaaccccgggtttcggggtaccccgggggtacccgggttaaccgggggttaaccccccg

SEQ ID NO: 262842 - DNA, 716 bp, Homo sapiens
  misc_feature: GYAE6OF01DUCDD.8.33.C11.1.454.CMB.1.raw
tcagctcgcgtgtccacgaccggtgctcgatttagagtgagctcgttggggtttgggggaggaactgctcagttaggacccagagggaaccatggaagccccagctcagcttctcttcctcctgctactctggctccagtttcagataccgaccggagagattgtgttgacacagtctccacgccaccctgttctttgtctaccgaggggaaagacgcccaccctctcctcgcgagggcctagtcaagaattcggttacggccgtccttacggtaacgtcgttaacggtaacccaaacaacctaaaaccgtcggacccgtaacggtccctacccgaccggtcccccctacaacttccgttagttcggtcgactaactaccgaacgacgggccaacgtcggaccactcccgacgtccgtaggtcaggtcggacgtaggtaggggtactggggaactagtaccttacgacctttcgaccaactactactacgtcacgcccgtggactccgtaggaagtagttcggttagtacttacgtttaacttacgtacgtaactaacgtacgtaccgtacggtacggtccggtcccgggtccggggtaccttccggttacccggccggttacgggaacggtacggtaggacgtaacgtaacgaaccggtaagttcggtacggaccttcgggacctaccgttactccgttcgttcttcccgtaccg

SEQ ID NO: 262843 - DNA, 809 bp, Homo sapiens
  misc_feature: GYAE6OF01BAS7X.8.33.C11.1.454.CMB.1.raw
  modified_base (215)..(215): a, c, t, g, unknown or other
  misc_feature (215)..(215): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagactaccaccggagagattgtgttgacacagtcctccagcccaccctgtctttgtctccgaaggggaaancgcccaccctctccgtgcgacgggccagtcaagtaatggttacggccgtccttacgtaagcttacggtaaccaacaaccaaaccgtggacccaggccctaccgaccggcccctacagtctagtggtcgacctactacccgaacgcgggacccagtcggacctacgtccccgaagtcccgtaaggttccgaaggtcggactagggttgggactggggactaacgtacgttaccacgttccgactaaccacgttaccacgtacgacgtccgtacgggaccgtaccgtaaggaaaccgttagttacggtttcgtaaccgttaacgtttttaacgttaaccggttagtaacccgtaaacgttacggttacccggtaacgggtaccgggttacccgggtacccccgggttacccgggggtacccccttaccgggtttccccgggtacccgggtaaccgggtaaacccggtagggttaaccgggaaccgtaaaccggttaaacccggtaaaccggtaccgggttacggtacgggtacccgttacccgaacccgttaacccgttacgttacccgtttacggttccctttaaccgtaccccg

SEQ ID NO: 262844 - DNA, 612 bp, Homo sapiens
  misc_feature: GYAE6OF01ETZ94.8.33.C11.1.454.CMB.1.raw
  modified_base (276)..(276): a, c, t, g, unknown or other
  misc_feature (276)..(276): n is a, c, g, or t
tcagctcgcgtgtccacgaccggtgctcgatttagagtgagctcgttgggtttggggggaggaactgctcagttaggacccagagggaaccatggagccccagctcagcttctcttcctcctgctactctggctcccagtttcagataccaccggagagattgtgttgacacagtctccagccaccctgtctttgtctccgaggggaaagcgccaccctctcctgcagggccagtcagaatgttggcgccttcgagctggtaccaacaccaaaccncgccaggcctcccacggcccctcactctatggtcgcactcaaaacacggggcccaacgtcggcagttcccccaagcccagggttccaaggttcggcaggtcggggtaatggggacaggacttcgacctctcaccatccatcacgccgtaggacgtccgtagagagtagtcgtcgtagttattacgttacgtactaacgtacgtacgtaccggtacggtcggtccggtccgggtccgtaccgttccggtcccgtacgggtaccggtacggtacggacgtacgtacgaaacgtaacgtacggtacggtcgtcgacctaccactcgttcgttccgttac

SEQ ID NO: 262845 - DNA, 554 bp, Homo sapiens
  misc_feature: GYAE6OF01BKIE4.8.33.C11.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (392)..(392): a, c, t, g, unknown or other
  misc_feature (392)..(392): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctcaggggaangccacctctcctgcagggccagtcagatgtgcncttgaanctgtacaacacaaacctggccagcctccacggcccctcatctatcggtgcataccaacgagggccacgtcggcaactccccagccaggttcaggtggcgaggtggggtatgggactagtcttcactctcacatcatcacgtccnggacacctagaagagttgtagtctagtttatactagtaccaatacttaccggtacgtcgtcggcccggtccggggtacctacgttccggccgtcgggacgtaaggtcggagtactacgaaacgtagtagtcggactgacctactactattcgtctcgtaccg

SEQ ID NO: 262846 - DNA, 882 bp, Homo sapiens
  misc_feature: GYAE6OF01DHB0U.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacccttgtctttgtctccgaaggggaaagacgccctaccctcctcctgcgacgggccagtcaagtaagtggttcggcgtccttacggtaagtccgtaggtaaccaaaccaaaccgaaaccgtacggacccacgggtaccctcccgaaccggcccccctacaacttctagtcggtcgacactaccgaacgacgggccacgtcggactacgtcccgacgccgtacggttcacggtcggcgtagggtaggggtacggtaggggaactacggtaccttacgaccttaccgtacctaaccctactaccgtaactaccgtaaccggtcccggttaacgggtacgaacccgttaggtaaacgtacggtttacggttacggttaaccgtttaaacgggttttttaactttaaccggtttagttaaacccttaaacgttaaccggtttacccgggtttaaccgggtacgggtttaaccccggggtcccccggggtttacccggggggttaacccctttaacccggggtttttccccggggaccccgggttaacggggtaaccccgggtttaaaggggtaaccgggtaaacgttaaaccggtaaacccgggtaaaaccggttaaaccgggttgggttaccggttacccgtaacggtaacccgtacgttacgtttacccgttttacggttacccgttacccgtttaacccg

SEQ ID NO: 262847 - DNA, 821 bp, Homo sapiens
  misc_feature: GYAE6OF01CE35B.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccacgccaccgtgtctttgtctccgagggaagacgcccacctctcctgacgagggccagtcagtaagtgtggcgtccgttagtaagcgtacggtaaccaacaccaaaccgtcggaccgaggccctcccgaaccggtcccccttacgaactcgttaacgtcgggtacacctacgtacccgaaaccggacgggaccctaaggtccgggacctaacccgtccccgaacggtcccgtaacgggttccgaacgggttcggaacgttagggtacggggtaaggtacgggaactaacggtacctttaccgtacccttcctaacctaaccctaactccgtaacgtacgtaccggtaccgtacgggaaccgtacccggttaggtaacgggttagttacgggtttgtaacgtttacgttttaacttacgttaccgtaacgttaaacgtacgtaccgttaacgggtcgttacccgggtccccgggtacccgggggtcccttacccggttcccggtacccggtaaccgggtaaaccgtaacggtacggtaaccgttaaccgaaaccggtaaacggttaccggttagggtacccggtacggtaacccgtaccgtacccgttacgttaccgtttcgtttacccgttccgttaccccgg

SEQ ID NO: 262848 - DNA, 646 bp, Homo sapiens
  misc_feature: GYAE6OF01EPBMN.8.33.C11.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaangcccaccctctcctgcagggccagtcagatgtgcgtcttgagctgaccaacacaacgtgccagcnccacgccctcatctagtggtcncactaccgaacgcgggaccacgtcggcactacccgacgtaccgtaggtccaggtcggacgagggttagggtaggtagggacaacggtaccttcacctctaccaccatacacgtacacgtccgtagggactaccgtaggaacgtagttcgttcgtacgttacgttttattcgtacttaactaacgtacgtaccggtacggtacggtccgggtccccggtcccgggggtaccttccggttcccggcccggtacgggaccgtaggggtcgtaacggtacgttaaccggaaacgttacgtcgggtacgccgtacgaccctacgtacttaccgttcgttaccgttccgttaacccg

SEQ ID NO: 262849 - DNA, 740 bp, Homo sapiens
  misc_feature: GYAE6OF01CPOFC.8.33.C11.1.454.CMB.1.raw
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagactaccaccggagagattgtgttgacacagtctccacgccaccctgttctttgtcctccgaaggggaaagacgcccaccctcctcctgcgacggccagtcagatgttcggccgtccgttacgtagcgtacggtaaccaaccaaccaaccgtcggaccgacggacctcccgaccggccccctctactctagtggtcgctacgtaccgaaaccgacgggaccacgtcggacctaccgtacccgacgaccgtacggttcgtaggtcggacgagggtggggtaggtagggacgaacgtacttccaccttccgtacctacctactactactccgtacgccgtacggaccgtacgtaggtaaagtgttaggttcgtacgtttagttttacttacgttccgtaactaacgtacgttacccggtaccggtcggtccggggtccccgggttcccgggggttacccttccgggtttccccgggacccgggttacgggaacccggtaaggggtacgggtaacgtaaccgtaaccggaaaccggttacggttcgggtacggccgttacgacccgtaccgtacttccgttacgttcctcgttccccg

SEQ ID NO: 262850 - DNA, 823 bp, Homo sapiens
  misc_feature: GYAE6OF01CCXDQ.8.33.C11.1.454.CMB.1.raw
  modified_base (242)..(242): a, c, t, g, unknown or other
  misc_feature (242)..(242): n is a, c, g, or t
  modified_base (737)..(737): a, c, t, g, unknown or other
  misc_feature (737)..(737): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccagtggtagtttgggctgaacgttgggttttcctcgttgcttctttaagaggtgtccagtgtcaagtgctaacgtggtggagtcggtgggggagcgtacgtccgaggccgtggggacgtcacgngagacctcgtccgtgtcgcgacgtccgttcgtcgggttaccaccgtttcgaggttacgcgtaccggtcagtccgactaccggtcggtcccgaccaaaccgtccgagggacgtaaagggtgttacggggaggttgggtcggacgttagggttttcgttaccgtaagtccggttagggaccggggtatacgggtttcgtttaacgaaggtttcgggtaattccgggacgttaccggggaaacccggtttccgggtaaaggggtaacccgggtccttaaacgtttaccccgaacgtaaccgttccctaacccggaagtaacccgtaaactaaaccccggttaccgaaaacggtacctaacgtaagtttacggtttaacggtttaccgaaccgtaacgaacgtaccgtaaccgtaacgttaccggacggaaccgggtacgtaacgggttattaacgtaccgtaaggttacgggaacgggaaacggggtacgggaaccgngggttaacggtaccgttaaccggtacgttaccggtttaccgttacgggaccggttacgggtaccgggtcccgtacgggttacccgg

SEQ ID NO: 262851 - DNA, 749 bp, Homo sapiens
  misc_feature: GYAE6OF01DWJL0.8.33.C11.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaangccaccctctcctgcaggccagtcagatgtgcnctganctgtacacacaactgccagctccagcccctnatctatggtgcatccaacgacgggccacgtggacactcccagacccgtaggttacacggttcggaccgtagggtaggggtacgtacgggggaacctaacggtaccgtttccgaaccttccgttacccaaccctaacttacctaacgtaccgaccgtccgtacgggtacgtacccgttaggaacgtacgttggttacgtacgttaaggttttactttaccgtagttaccctaaacgtacgttaccggttaaccggtacggttacccgggtacccggttaccccggggggtaccctttacccgggttttacccggggtacccccggttacgggggtaaccccggtaaacggggttacgggaaacggttaaccgttaacccggaaaaccggttaaaccgttcggggttacggtacccgttacggaacccgtaacccgttaacgttcccggttacgtttcccgttaccgttaacccg

SEQ ID NO: 262852 - DNA, 728 bp, Homo sapiens
  misc_feature: GYAE6OF01DFIU0.8.33.C11.1.454.CMB.1.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcaggccagtcagaatgttgcgcttcgtaagctggtaccaacacaaactgccaggtacnccacggcccctanactctatggtcgacactccgaacgacgggcctacgtcggacacgtccccaagcccgtaaggttccaacggtcggcgtagggtacggggttagttggggacctaaggtacctttaccgacgttcctacctaaccataccacgttaccgacggtcccgttacgggacgtacccgtaggtaaacgtactttaggttacggtaccttaagtttttaacgtttaaccgtaggttaaccctaactacggtttaccgttaacccgggtaaggttcccggggtaccccgggtttacccggggggtcccttaaccggtttttccccggggacccgttaccgggggtaaaccgtagggttacggaacggtaacgtaccggtaaaaacgtagttcggtacggtcgtacgaccgtactaacgttcgtttacgtcctttcggtaaccc

SEQ ID NO: 262853 - DNA, 889 bp, Homo sapiens
  misc_feature: GYAE6OF01EP54H.8.33.C11.1.454.CMB.1.raw
  modified_base (180)..(180): a, c, t, g, unknown or other
  misc_feature (180)..(180): n is a, c, g, or t
tcagctcgcgtgtccacgaccggtgctcgatttagagtgagctcgtgggagaggagcccagcactagaagtcggcggttgtttccattcggtgatcagcactgaacacagagactcaccagtggtaggtttgggctagtaacgtttgggtttttcctcgtttgtctttacgttttaaggnggttcgtccgtagttgtactaaggtcgaccgtaacgttgggtggtaggtcggtgggggacgtcgtagtccgagtccggtagggacgtacacgagacgtaccttcctccgtgtcgcgacgtccgttcgttcggttcctacccttagaaggttacgaccgttacggctacgttcgaccgtacgtccggtaccccgaacctaacgcggaacggacggtaaggtcggttaggagggttcgggtcgtacttaggttttcgtcgtacgttcggtagggtacggtcttaggtttacgtacgttaaggttcggtagttcggtaccgtacgggtaacccgggtcgggtaacggtaacccgggtacttaccgttacccaaccggttaccttaccgaccggtaaagtaaccaaacccgtaacccgtaacgtaaacggaaccctaacgtttaaggtttaccgttaccgtttaaccgaacgtttaacggaaacccgtacggtttaacccgtacgggttaacctaagggaccgggttaacggttaccggttttaaataaccgttaacggtacggttaacggggaaacgggtaaaccgggggaaacgggtacccggtaaggggtaccccggtttaaactttaaccggtaacccggtttacccgtttacgggttacgggaccggtttacccggggacccgggtttaaaccgcgggtttaaccccg

SEQ ID NO: 262854 - DNA, 821 bp, Homo sapiens
  misc_feature: GYAE6OF01AUW9O.8.33.C11.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagtgagctcgttgggtttgggggagggaacgtgctcagttaggacccagagggaaccatggaagcccagctcagcttctcttcctcctgctactctggctccagtttcagataccgaccggagagattgtgttagacacgagtctccagccacctgtctttgtcncgagggaacagccacctctcctgccgaggcctagtacgagtaactggttggccgtaccttacgtaacgccgttaggttaaccaaccgtaacctaaaaccgtcggaaccgtacggtaccgtacccgtacccggtaccccgtacctacgttaccgtacgttacggtacgaccgtactaaccgaaccgtacgggaccgtaaccgtcgggacctactacccgacgaccggacggttacgaccggtacgcgtaacggttacggggaagttcgggtaacgacgttaacgtacgttacctcgttccaacccttagtacacgtcgaacgtccgtacggacgtacctacggaacgttagttacggtcgttaacgttagttttaaacctttcggttaaccgtttactaactaacgtaccgttaccgggtacggtaacccgggtaccgggttccggggtacccgttaccggtttcccggacccggtacccggtaacggttaacggggacggttaccggaaacgtttacccggtaaaaccggtaaccggttacggttaccgggtaccgttaccggaaacccgtttacccgaagggtttaaccgttcccttcgggtttaaccctttaacccggg

SEQ ID NO: 262855 - DNA, 636 bp, Homo sapiens
  misc_feature: GYAE6OF01DZP3C.8.33.C11.1.454.CMB.1.raw
  modified_base (243)..(243): a, c, t, g, unknown or other
  misc_feature (243)..(243): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (481)..(481): a, c, t, g, unknown or other
  misc_feature (481)..(481): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
  modified_base (629)..(629): a, c, t, g, unknown or other
  misc_feature (629)..(629): n is a, c, g, or t
tcagctcgcgtgtccacgaccggtgctcgatttagagtgagctcggttggggtttgggggaggaactgctcagttaggacccagagggaaccatggaacgccccagctcagcttctcttcctcctgcctactctggcctcccagtttcagactaccaccggagagtattgtgttacgacacgtatcctccacgccctacccttgtctttgtcgtaccggaagggaaacacgcccctaccgtcnccgtgcgtacgggccagtcagtagtcgtcggcgccgtttagacgcgttaacgaccaaacgaccaaccggtcgacgccgtccctacccgccgaccttnactattcggtgacacgtaccaacgaggccgacctcgganccncgtacagtcgtagacgtgacgaggtgtaggtcggacacgtaactaccncgtactcaacngactcgtanccgcgtgacgtcacgtataacgtgtgacgtntttaactgttacactacgtacgttaccgtaccggtacggtaccggtccgggtcccggaccgttacgttcccgtcgggtaccgaacgttaggacggtagtacgaaataaccgggnttacggngtctacgactcacgttctatcctaccncgttccg

SEQ ID NO: 262856 - DNA, 713 bp, Homo sapiens
  misc_feature: GYAE6OF01AIR9M.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcgagggccagtcagaatgttggcgccttcgtaagctcggtaaccaacacaaacctggccaggcctcccgacggccccctcactctagtggtcgcactaccaacgacgggcccacgtcggaccactcccgacgccgtacggttcgaggtcggcgtagggtgggtagtacgggacacgtaccgttcaccgtactaccaacctactctaacgtcgaacgccgtagggaccgtccgtaggaacgtagttcggttagaccgtttaagtttaacttacgttataccgtaaactacgttaccggtaacccggtggttaccggggtccccgggttacccgggggtacccttacccgggtttcccgggacccggtcgggaacccgggtaagggtcgggaaaccggtacgtaaacccgtaaaccggtaacggttcggtcgggtaccctaggacccctaaccggttacttacccggtttcttaccgtttcgtaaccccg

SEQ ID NO: 262857 - DNA, 872 bp, Homo sapiens
  misc_feature: GYAE6OF01COAEH.8.33.C11.1.454.CMB.1.raw
  modified_base (220)..(220): a, c, t, g, unknown or other
  misc_feature (220)..(220): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccctagtttcagataccaccggagagtattgtgttgacacagtctccacgccctaccctgttcgtttcgtctccgaaggggaaacncgcccaccctcctccgtgccgacggccagtacgagtaagttggtcggccgtccttacggtacgtcgtacggtaacccaaacgaacctaaaaccgtccggaccaacggtccctacccgaccggtaccccctactacgttcctacgttcgggtcacgaaccttacccggaaacggccgggaccctaccgaggtacccacctacccgacgtaccgtacggttacacggttacggacgtagggtttagggggtaacgtcgggggtaactaacggtaccgtttaccctaccttcccgtaccctaacctaccgttacaaccgttaccgaccggttacccggtacggtacgtacccggtaagtaacggttacgttaggttacgtacgtttaacgtttttaacttaaccgttacgtaaccctaaacgttaccgttacccggggttaaccggttccgggtacccggggttaccccggggtttacccccggggtaccctttaccgggttttacccccggggtaccccgggttaaccggggtaacccggttacggggtaacggtaaccgttaaacggtaacccgtaaaaccgtgggttaccggtacgggacctacggtacccgtaaccgttcctaccgtttccgttaccttccgttaaccccg

SEQ ID NO: 262858 - DNA, 670 bp, Homo sapiens
  misc_feature: GYAE6OF01EFSAI.8.33.C11.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
tcagctcgcgtgtccacgaccggtgctcgatttagagtgagctcgttgggtttgggggaggaactgctcagttaggacccagagggaaccatggaacgccccagctcagcttctcttcctcctgctactctggctcccagtttcagactaccaccggagagtattgtgttgacacaatctccagccacctgtctcgtctcgagggaangccacctcnctgcaggccagtcagatgtgcnctagtanccgtaggtaccaacagaacctggccaggtctaccacggcccctnactctacttgggacncatccaacgcgggccaacgtggcatccgagcctaggtnacgtgcaggtggtacaggggacaggacttcgactactacgacctatccgaagtacacggaccctagggacgtcccgttagtacgggtaagtttcggtacgtcggtaaacggtttttaattaaccgtggttaaccaactaacggttacccgtaccgggaacggttttccgggaaccccgggttcccggggggtaaccttcccgggttttacccgggcccttaccggggggaacctaaaacggtttcggaataacggtaaccgaaaaacgttacgttgggtacggccgttaggacccaaaccggctttcgacgtttcctcgttaacccg

SEQ ID NO: 262859 - DNA, 838 bp, Homo sapiens
  misc_feature: GYAE6OF01A9UIE.8.33.C11.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaanacgcccaccctctcctgcgaggccagtcagatgtgcnctgtanctgtacacacaactgccaggcctcccgacgcccctcgactccgtagtcggtcgacctactacccgaacgacgggccctaacgtcggacctaccgtccccacgtaccgtacggtaccaggtcggacgtaacggttaggggtacgttacggggaactaacggtaccttacccaccgttcccgtacctaacctaacgtaccctacgtacccaacggtcccggttaacgggaccgtacccggttagtaaacggttacggtttacggtttaccggaaccgttttaaggtttttaagtttaacccgtaccggtttaaccctaaacgtttacgttaccccgggttaaaccggtcgggttaccccgggtacccccggggtttacccccgggggtaacccgttttacccccggggttttacccgggtaccccccgggtaacgggggttaacccgtaaacggggttaccgggtaaccgttaaaccgtttaccccggtaaaaaccggtttaacccggtgggttaacccgggtaaccttcgggtaaaccctaccccggttaattcccgtttacgtttcccgttaccccgttacccgg

SEQ ID NO: 262860 - DNA, 918 bp, Homo sapiens
  misc_feature: GYAE6OF01CIR1F.8.33.C11.1.454.CMB.1.raw
  modified_base (223)..(223): a, c, t, g, unknown or other
  misc_feature (223)..(223): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagactaccaccgggagagattgtgttgacacagtcctccacgcccaccctgttctttcgtcctaccggaaggggaaacnccgacccacccgttctccgtggacgacgggccaggtacagtaagtggttacggccgtcgttacggagtccgtacggtaacccaaaccaaccgaaacccgtcggaccgacgtccctccccgacggccccctacacttacgttagtcgggtacacctacctaaccgaacggcgggtacccaccggttacgacccgtacctaccccggacgtaccgtacgggttcgaacgggtcggtaccgggtagggttacgggggttaagtaccggggaacgtaaccggttaccgttaccgtacccgttacccgtacctaaccctactaccctaagtcccgtaaccggtcccgtaacggggaccggttaacccgaaggttaaacgggtacgttacggtttaacggtttaccggtttaagtttttaccgttaaccggttctaaaccggtaaccgttaaccggtttacccgggtaaccgggttcccggggtacccggggtttaccccccgggttaccccggggggttaaccccgttttaccggggtttccccccggggttaacccgggtacccgggggtaaacccggttacggggggttaaccgtaaacgggttaacccgaaacccgggttaaaccggttgggttaacccgggtccggtccgtacgaccgttaccgtacgttccgttacgtccgttacccttacccgg

SEQ ID NO: 262861 - DNA, 779 bp, Homo sapiens
  misc_feature: GYAE6OF01B739F.8.33.C11.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (746)..(746): a, c, t, g, unknown or other
  misc_feature (746)..(746): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggcctcccagtttcagactaccaccggagagattggtgttagacacgtagtcctccagcccaccttgttctttgtcctaccgaaggggaaancgccctacccgtctcctgcgacggccagtcagtaagtggttcggcgtccttagagtcgtacggtaaccaaacaaccgaaaccgtcggaccacggtcctccgtacggcccctntactaccgtagtgggtcacctactaccgaacgcgggaccacgtcggacacctcccgacgtccgtacggtcaggtcggacgtaggttgggagtcgggaactacgtaccgttacacgttacctacctaacctataccgtaacgtccgtacggtaccgttagggaacctcggtaaaagtaacggttaacttcggggtttaactagttttaagttttaaccttacgtacgtaaacgttacgtaaccggttacggtaaccgggtacggttaccgggacccccgggttcccggggtaacctttacccgggtttcgggaccccgggtacggggaaccggtaaagggtcgggaacgttaaacgtaaacccggtaaccgggtacggttacggcgggtaccttaccgggaaccgtaaccgttntaccccggtttggttaacccttcgtaaaccccg

SEQ ID NO: 262862 - DNA, 829 bp, Homo sapiens
  misc_feature: GYAE6OF01BDQ84.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttgggtttgggggaggaactgctcagttaggacccagagggaaccatggaaggccccagctcagcttctcttcctcctgctactctggctcccagacgacgaccggagagattgtattgaacggcagtcctccaaccaccctgtctttgtctccgtggggganacgcccaccctctcctgactagggccaaggtcgtaaccttttagtagttagttagtttacgtcctaggtatacggaactaaaaaccgtggaccacgggtccttcccgaacggtcccctacaacttcctaagtggtcgtactaacgtacccaaacgacgggaccctaacggtggaacctacgtaccccgaaggtaccccgtaaggttaccaagggtcggtaccgtaaggggttacggggtaagttacgggggaaccctaacgtaccggtttaccaacgtccgtaccgtaaaccctataccgtaacgttacaagtaccctaaggtacgggacgtaccgtagggaacggtaagttgggttacgaccgttaagtttaacttaccggtaacgttaacgtaaacgtaccgtaccggttaaccggtacggtaccgggtacccggtaccgggggacccttaccggtttcccgggaccccgtacggggaaacccgtaaggtaccggtagtaaccgtaaccgaaaaacggtacgtacgggtcggtaccgtacggtaaccctaacgttacgtacgttaccttaacccgtttacgtaaaccctttcccggttaacccccgtagttaaaccccg

SEQ ID NO: 262863 - DNA, 785 bp, Homo sapiens
  misc_feature: GYAE6OF01C88UD.8.33.C11.1.454.CMB.1.raw
tcagctcgcgtgtccacgaccggtgctcgatttagagtgagctcgttgggtctgggagaggagcccagcactagaagtcggcgtgtttccattcggtgatcagcactgaacacagaggactcaccatggagtttgggctagacgtgggttttcctcgttgcttatttaaggagtgtcagtgtcaagtgacaagtggtggattcggaggggggagtcgtacgtccgaggtccgtaggggagtccaacgagtacgaccttctccgttggcgacacggtccttacggtacgggttacctacctcgtaagttaacgccgttaggcgtaatgactacggttcggaccctaacgaaaccgtccgaggacgtaagggtagtttaggggacgtggggtacgtcgtaaggtttcgtttaaccgagttccgtacgggaaggtcgttagggttaaccggttactaaaacggttcggtaaacgttggtaccgtacggaccggtacggttaacgggaacgggtcctaacgttcccaaccttacgtcccacgaagtacgaaacctaccaaccggaagtaacccgtaaataggttagttaacgtttacggaacctttaacggaacacccgtaagtaaccgtacgtaggtacggacgtacgggtattacctaacggttacgaaccggtaaggtaacgggggaaaccgggaacccgtaaggggccggtttaacgtaaccggtaaccgtttacgtttaacccgggttcgggttaccggtacccgggttcggggtaaccccggg

SEQ ID NO: 262864 - DNA, 753 bp, Homo sapiens
  misc_feature: GYAE6OF01AQEZW.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtctccagccaccctgtctttgtctccgagggaagcgccacctctcctgcgacgggccagtacagtaatggttcggcgtccgttcgtaagctacggtaaccaaccaccaaaccgtcggaccacggccctcccacggtccccctactactcgtacgtggtacgcacgtaccgacgacggcctacgtcgcactcccgacgtccgtacggttcgacggttcggacgtacggggttaggggtacggtacggggaaccgtacggtacccttaccgaccctttacgtacccaaccgttactaccgaaccttccggaacgtcccggttacgggaccgtaccgtaggtaaacgtagttggttcgtacgtttaagtttacttacggtcgtaaccttaacgtacgttaccggtaccggttacggtccgggtccccggggttcccggggtaccgttacccgggtttccgggacccggtaccggggtaaccggtaaggggtcggaaacgttaacggtaaccgtaaaccggtacggtacggtacggtcggtaccgacgaacccgttataccgtttcgttccttccgtacccg

SEQ ID NO: 262865 - DNA, 870 bp, Homo sapiens
  misc_feature: GYAE6OF01A82WX.8.33.C11.1.454.CMB.1.raw
  modified_base (189)..(189): a, c, t, g, unknown or other
  misc_feature (189)..(189): n is a, c, g, or t
  modified_base (237)..(237): a, c, t, g, unknown or other
  misc_feature (237)..(237): n is a, c, g, or t
tcagctcgcgtgtccacgaccggtgctcgatttagagtgagctcggtttgggtttggggaggaactgctcagttaggacccagagggaaccatggaacgccccagctcagtcttcctcttccctcctgcctactctggcctccctagtttcaagactaccgacggagagtattgtgtagacacagtccnccacgccctacccgttgttcctttcgtccgtaccggaaaggggaaacnccgaccctaccccttccgtccgtggaccgacgggaccctaggtacaaggtagttcggttcggccgttacgttacgtaacgtcgtacgaaccaacaaccgaaccgtcggcacggtccctaccgacgccctatacttccgtagcggtacacctacgtacccgaacggcggacctaccgtacgacctaccgtaccgacgtaccgtaggttacgaccgggtagtcggtaggggtacgggtaggaacggtaacgacgttacccttactacccgtacttaccaacctacgtaacgacgtaccgacggttacccggaggtaaccttcggaaagttaaccggtgtttagggtaaccgttacttttaaggtttaccttacggttaaccgttacccgaaggtttacccgtttaccccgggtagggttaccccgggtacccgggttacccccggggttacccggggttaccctttaccggggttacccccggtaaccggggtaccggtaacggggtaacggttcgggtaaaacgtacccgggttaaaaccggaacccggtttcggttaacgggtcccggacctacccggtaaccgtactttaccgtttacccggtttacgtaacccccgtttctaacccccggg

SEQ ID NO: 262866 - DNA, 776 bp, Homo sapiens
  misc_feature: GYAE6OF01B20KU.8.33.C11.1.454.CMB.1.raw
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
  modified_base (162)..(162): a, c, t, g, unknown or other
  misc_feature (162)..(162): n is a, c, g, or t
tcagctcgcgtgtccacgaccggtgctcgatttagagtgagctcgttgggtttgggagcccagcactagaagtcggcggtgtttccattcggtgatcagcactgaacacagagactcaccatggagttggctgactggtttcncgttgctctttaagnggtntccagtgtcaagtgctaactggtggagtcggtggggagcgtagtccagccgtgggagtcacagacgtactcgtccgtgtcgccagtccctgttacgggttccaacctttgacggttacgaccgttaccggctaactcggacctaccggttcgggtacccaaacccgtaaacttcccggaagggtacgtaaggggtcgttagggaacggtcggggtagtcgttagggttttacgtttaccgagttccggtaagggtacgggtcctagtttacgttacaacggttggtacttacggctacggtaccggaccgtagggaacggtcccgtaatttaccgacccgtaagttcctaaccgaggtaaccaaccgttaacaaccgtaggaaacctaacgttacgtaaggttaacctacggaacccgttaagaaacctcggttaacccgttaaggtacccgttagggaacccgggattaacccggggtattaaccgtttaaggtaccttaagggaaacgggaaaccggggttaccgggaacgtagggccggttaagtaccggtacgtaccgttacgtttcggaaaccggttcgtaacggggaccttccgggtacccttacggg

SEQ ID NO: 262867 - DNA, 866 bp, Homo sapiens
  misc_feature: GYAE6OF01BDR9W.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagtattgtgttgacacagtctccacgccaccctgtctttgtctccgaggggaanacgccaccctctcctgcgagggccagtccgaagaagttggtttcggccgtccgtttacggtaacggtccgtacgggttaacccaaacaaccaaaacccgtggacccgacggtccctacccgacggtccccctcacttacgtagtcggtagccaactacccaaacggacggggacccacggtccggactaccgtaccccgacgtacccgtaacgggtttccagggtacggtacggtaaacgggttcgggggttaaaggtacgggggtaaacctaacggttaccgttacccgtaaccgttcctaaccctaacccgtaacttaccctaacgttaccgaacggtcccggttacgggaaccggtccgtacgggaacggttacgttcggttacgtacgggtttaattttaacgtttaacgttaccgtaaccgtaaaccgttacgttcccgggttaacccggtccggggtccgggttacccccgggttcccggggggtacccctttacgggtttccccgggaacccggttacggggtaaaacccggtaagggttccggggaaatttaacccggaaaacgtaaaacccgggttacgttacgggtccggtaccgttacgtcccgttaaacttcgttacccgttcgtttacccttcggttaacccg

SEQ ID NO: 262868 - DNA, 900 bp, Homo sapiens
  misc_feature: GYAE6OF01B9E4P.8.33.C11.1.454.CMB.1.raw
tcagctcgcgtgtccacgaccggtgctcgatttagagtgagctcgtttggggtttgggggaggaactgctcagttaggacccagagggaaccatggaagccccagctcagcttctcttcctcctgctactctggctccctagtttcagactaccaccggagagtattgtgttgacacgtagtcctccacgccctacccttgtttctttgtcctaccggaaggggaaacgcgccctaccccttctccgtcgaccggaagggccctaaggtacaaggtaagttcgggttcgggtccgtcccgtttaggtaacggtccgttacggtaacccaaccgaaaccgtaaacccgtcggacccgtacgggtccctacccggaccggtaccccctcgtacttaccgttagttcggtcgtacctaccgtacccgaaccggaaccgggtcccacggtaccggacctaccgttacccggacgaccggttacggtacgtacggtacgggcgttacgggggtacggggttaacggacgggggtaacctaacgggttacctttaccgaccctttaccgtaacccaaccgttactttacccgaaccgttccgtaaccggtccgtacggggtccgtacgtttacgggacggtttaagttgggtttaacctacggttttaagttttacgttacgttaccgtaaccttaacggttacggtaacccgttaccggggtaacgggtccccgggttacccggggtccccgggggttaactttccccgggtttaccgggacccgggttaccggaaacccgggttagtaccggtaaacgtccgaaaacggttaaccggtacggttcggacgttacggaccgtaaccgtacgtccttaaacccggtctttccgttaaccctcccgg

SEQ ID NO: 262869 - DNA, 877 bp, Homo sapiens
  misc_feature: GYAE6OF01CE8K7.8.33.C11.1.454.CMB.1.raw
tcagctcgcgtgtccacgaccggtgctcgatttagagtgagctcggttggggtttgggggaggaactgctcagttaggacccagagggaaccatggaagccccagctcagcttctcttcctcctgctactctggctccagtttcagataccgacggagagtattgtgtgacacagtcctccacgccctaccctgttctttggtacctaccggaaggggaaacgaccgcccaccctccgtcctggccgacgggcctagtacgaagtaagttcggttcggccgtccgttacggtacggtccgtacggtaaccaaaccaaccgtaaaccgtcggaccgacggtccctacccgacggtcccctatacttaccgtagtcggtcgactacgtaccgaaacggtaccgggaccacggtcggtaccaaccgtacccgacgaccggtacggtacggtacgggtcggacggtagggttacgggttagtacgggtacgtaacgtaccgttacgtaccttcccgtacctacccgttactaaccgtacgtacccgtacgggtaccgttaccggggacttacggtaagtaagtttaacggtttcggtttcggtaacctttaaggttttaaaccttaccggtacgttaacccgttaacgtacccgggtttaccggttaacgggtccgggtttacccggggaccccgggttttaccgggggtcccttaccggggttccccgggtaacccgggtacggggtaaccggtaacggggtagtaaccgggtaaacgtttaaccgaaacgggtttcccggtaacggtacccgggtccgttaccggtaacccgttaaccgtttcgttacgtttcccggttaccttcggtttaacccccgg

SEQ ID NO: 262870 - DNA, 691 bp, Homo sapiens
  misc_feature: GYAE6OF01CBYE2.8.33.C11.1.454.CMB.1.raw
  modified_base (210)..(210): a, c, t, g, unknown or other
  misc_feature (210)..(210): n is a, c, g, or t
  modified_base (323)..(323): a, c, t, g, unknown or other
  misc_feature (323)..(323): n is a, c, g, or t
  modified_base (658)..(658): a, c, t, g, unknown or other
  misc_feature (658)..(658): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagtattgtgtgacacagtctccagcccaccctgttctttgtctccgagggaaancgccacctctcctgcgaggccagtacagtaatgtgcgtcttagaagtctaggtaaccaacaccaaccgtggaccacggcctacccgacgtcccctagactacgtagtggtacnccagtaccaacgacggacctacgtcgacctcctacccgagtcccgtaggttacgaggttccggagtagggttacgggtaagtacgggactaagtaccgttccaaccttctaccgaactagtacctacgtacgacgtccgtagggactacgaggtaaagtgttacgtcgtaactttaagttttacgtaccgtagttacctaaacgtcgttaacccggtaacgacgggtcccggtacccggggtcccgggtaacccttccggtttacccgggaccccgttaggggaacccgttagggtaccgaacgttaacgaccgtaaaacgtcgttggcgtaccngtaaccctacgtactcttacgtctacttacccg

SEQ ID NO: 262871 - DNA, 869 bp, Homo sapiens
  misc_feature: GYAE6OF01CJJ57.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaancgccaccctctcctgcgacgggccagtcagaatggttggcgtccttacgagctaggtaccaacaacaaaccgtggaccacggcctacccgacggccccctcacttcctagtcgggtcacctaactacccgaacgacggggtacccaacgttcgggactaccgtaccccacggccgtaagggtttccgaacggggttcggaccgtaaggggtttacgggggttaacggtacgggggtaacctaacgggtacctttaccgaaccttccgtaccacccgtagttaccacttacgacggtcccgtagggacgtacccgtaaggtaacgacgtttcggttacgtaccgtttaagttttaacctttaccgtacgttaaccgtaaacgttcgttaacccgggttaaccgggtaacgggttcccgggtaccccccggggtttaccccgggggggtaacccctttaccggggttttacccccgggaaccccggggtttaaccgggggtaacccgggttaaacgggggttaccgggtaaacgggttaaacccgttaaaccggtaaaaacccgggttacgggttacgggttaccgggtaccgttacccggtacccctaaacccggttacgtttaccccggttacgtttacccgtttccccgtttaacccgg

SEQ ID NO: 262872 - DNA, 789 bp, Homo sapiens
  misc_feature: GYAE6OF01CJTH0.8.33.C11.1.454.CMB.1.raw
  modified_base (159)..(159): a, c, t, g, unknown or other
  misc_feature (159)..(159): n is a, c, g, or t
  modified_base (209)..(209): a, c, t, g, unknown or other
  misc_feature (209)..(209): n is a, c, g, or t
  modified_base (486)..(486): a, c, t, g, unknown or other
  misc_feature (486)..(486): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctcggctcccagtttcagataccaccggagngacttggtgttgacacagtctccagccaccctgtctttgctccagggaangccaccctctcctgcagggcctagtacacgaatgttcggcgcctttcgtaagctggtaacccaacgaactaaaccgtggaccacgggtcctacccacgggtccccctactatcctaagtcgggtcgcctaacctaccgaaacgaccggggaccctaacgtcgggacctaaccgttccccgaagccccgtaagggtttccgaacggtttcgggaccgtaagggtcgggggtaatacgggggactaacggtactttaccaccgttcttaccgaaacccngttaccgacgtaccgtacgtacccggtacgggaacgtcccgttaaaggaaccggtagttacgtttacggtacctttaacggttttaacgttaccgttaacggttacctaaaccggtagtttacccgggtaacggtaccggtttacgggaccccggttacccgggggtaccttaccggtttacccggttacccggtacgggtaaccccggtagggtacgtacgtaacggtaacccgtaaaaccggtagtcggttacgggacttacggaccgtaccgtacttacgtccggttccttcgtaccccg

SEQ ID NO: 262873 - DNA, 786 bp, Homo sapiens
  misc_feature: GYAE6OF01E5BHU.8.33.C11.1.454.CMB.1.raw
  modified_base (133)..(133): a, c, t, g, unknown or other
  misc_feature (133)..(133): n is a, c, g, or t
  modified_base (166)..(166): a, c, t, g, unknown or other
  misc_feature (166)..(166): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccagtggagtttgggntgacgttggttttcctcgttgcttattttaagnggtgtccagtgtacaagtgactaacgtggtggagtcggtgggggagcgtagtccgagccggtgggagtcacgagacgtaccttcgtccgtggtcgccgacgtcccgttcgttcgggttaccacccgtttagaggttacgcctaacggcagtcgcgtacccgtgggtaccccacctaaccgtccgaggcgtaaagggtagttgggacggttgggtagtcgttaagtttcgtttcagttcggtagggacggtcgtaggtttagtacgtaaggttcggtacgtcgccgttacggtacggcccgggttagggacggtacccgttacgttaccgaccgtactaccgtaccgaaagaacctacccgtaaccttacccgaaaggtaaaccaacgtacgtttagttaaccggttaccgacgttaacgaaccgttacgtaacccgtaccgggttaaccacgggtaacggaccggtttaaggttaaccttacgtaaccgttaagggtcggttaaacggggaagggggaaccgggtaaccgtacggggttaacggttaacccggttacgtacgttaaccgtttcccggtggtacccggtacggggtcccggtaccggtccccgggttaccg

SEQ ID NO: 262874 - DNA, 819 bp, Homo sapiens
  misc_feature: GYAE6OF01B27R3.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggcctccctagtttcagactaccaccggagagtattgtgttgacacagtctccagcccacctgttctttgtctccgaaggggaacgacgcccaccctctcctgccgacgggccagtcgaagtaacgttcggttcggccgttccgtttacggtaacggtccgttaacggtaacccaaaccaaacccgtaaaccgtcgggacccgtaacgggtccctacccgaccgggtcccccctacgtaacttcgttacggtcgggtcgaccgtaaccgtaccccgtaaacggaccgggtacctaaccggtcggacctacccgtaccccgaggacccgtacgggttacgacgggtcggacgtagggttggggtaacggtcgggaacgtacggtacttaccgaccgtctaccactacgtactacgtacgacggtccgtaggaccgtacgttaaggtaacgtcgttacgggttactacgtttaacgtttacttaccgtacgttaacctaacgttcgtacccggtaacggtaccgggtcccgggtacccgggttccggggtacccttccggggtttacccgggacccggttaccgggaaccggttagggtccggtaacggtaaacgttaccggaaacgttcggttaggtaccgtcgtaccgtacccgtaacgttcgttacctacgtttccgtccgttacccg

SEQ ID NO: 262875 - DNA, 775 bp, Homo sapiens
  misc_feature: GYAE6OF01CX7DN.8.33.C11.1.454.CMB.1.raw
  modified_base (306)..(306): a, c, t, g, unknown or other
  misc_feature (306)..(306): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtcctccgaggggaaagacgcccaccctctcctgcgagggccagtcagaatgttggcgtctagagcgtagtaaccaacacaaaccgtggaccaggcctcccgacggccccctnacttcagtggtcgtacactaccaaacgacgggcccacgtcggacacgtccccacggacccgtagggttcaggttcggacgtagggttacggggtagtggggaactacgtaccgtttacaccgttccgtaccaacctatacctaacgtacctaacggtccgtagggaccgtaccgtaaggtaaacggttacgttagggttacgtaccgtttaagtttttacgtttaaccgtacgtttaaccaaacgttaccggttacccgggttaacccgggtaaccgggttccggggtacccccgggtacccggggggtaccctttaacccgggtttcccggggaaccccggttacggggtaaaccccggtaaaggggttcgggaaaccggttaacgtaaccggtaaaaccggttacggtacgggttccggaccgttacgaacctaccgtacgttccgttaccgttccgttcgtacccg

SEQ ID NO: 262876 - DNA, 832 bp, Homo sapiens
  misc_feature: GYAE6OF01A9DR0.8.33.C11.1.454.CMB.1.raw
  modified_base (211)..(211): a, c, t, g, unknown or other
  misc_feature (211)..(211): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaanacgcccaccctctcctgcgagggccagtcagaatgttcggcgtccttcgtaacgcgtacggtaaccaacaaccaaaccgtggccacggcctcccgacggccccctcactcctagtcggtacgcctactacccgaaacggtacgggccctacgtcggaccacttccccgagccgtaggttccgaggtcggacgtagggttcggggtagtacggggtactacggtacctttacaccttcctacctaaacccgtattacccaacgttccgtacggtacccggttacggggaaccgtacccggttaaggaaacggttcgtttacgggtttacggtacttttaaggtttttaacgtttaaccgtttacgtaaccctaaaccgttacgtttacccgggttaaccggttacggggtttacccggggtaccccgggttacccccggggggtaacccttttacccgggttttaccccggggaccccggttaacgggggtaacccggttaaacgggggtaccggaaacgttaaccggtaaaacccggtaaaaccggtacggtttcgggtcggacccgttcggtaacccctaaccgtactttacccggttcgtttcccttacccgttacccg

SEQ ID NO: 262877 - DNA, 634 bp, Homo sapiens
  misc_feature: GYAE6OF01EJPQ9.8.33.C11.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (387)..(388): a, c, t, g, unknown or other
  misc_feature (387)..(388): n is a, c, g, or t
tcagctcgcgtgtccacgaccggtgctcgatttagagtgagctcgtgggagaggagcccagcactagaagtcggcggtgtttcccattcggtgatcagcactgacacacgaggactcaccataggagtttgggctgaacttggggttttcctcgttgctcttttaagaggtgtccagtgtcaagtgcaacgtggtggagtcgtgggggaggcgtagtccagccgtgggaggtcagagagacctctaccgtgtgcagtccgttctgggttcaccttcgagtgcgttacggcagtgactcgtcggtcccaccaaactccgaggcaaggggtnttcgggagtcgggtgctaggtttnttcattcgtggaggctagtgtacagtgtatcgnngcgcgtagacgggtcctattccgactacgtccgtacgagacgtacgaactccgaaggtaacacgtaacgttagttaacgtttacggaaccttagaactcgtaccgtaagtccgtaggacggtacgtacgggttatacgtactacgaggtaacgggaacgggacggggaacctacgggcggtaacggttccgaacgttccttacccggttaggaccggttaggtccgggaccgtcgggttaccccgg

SEQ ID NO: 262878 - DNA, 657 bp, Homo sapiens
  misc_feature: GYAE6OF01EFE3A.8.33.C11.1.454.CMB.1.raw
tcagctcgcgtgtccacgaccggtgctcgatttagagtgagctcgttgggtttgggggaggaactgctcagttaggacccagagggaaccagtggaagccccagctcagcttctcttcctcctgctactctggctcccagtttcagataccaccggagagattgtgttgacacagtctaccagcccacccttgttctttgtactaccggaaggggaaacgacgaccctaccctctccgtgcgaggccagtcaagtaagttggtacgcgtccgttacgtaagctacggtaaccaacaaccaaccgtcggaccgacggccctcccgacgcccctactacgttactaggtcggtcactacgtaccgaacgacgggaccagtacgactacgtccacgtcgtacgtcgacggagacgtagggtacggtaggtacgggactaacgtacgttacaccgtcacgaccttaactactacgtacacgtaccgaggtcgacgtaggtagtagtgttagtacgtttagtttatacgtagtactaactacgtcgacgtacgtccggccggtccgggtccttacgtccggtaccgtaggacgtaaggtctacgtacgtaacgacgtagacgtcgactcgaccgtactcgttacttcgttactccgttaacc

SEQ ID NO: 262879 - DNA, 836 bp, Homo sapiens
  misc_feature: GYAE6OF01BZKPQ.8.33.C11.1.454.CMB.1.raw
  modified_base (226)..(226): a, c, t, g, unknown or other
  misc_feature (226)..(226): n is a, c, g, or t
tcagctcgcgtgtccacgaccggtgctcgatttagagtgagctcggttgggtttgggggaggaactgctcagttaggacccagagggaaccatggaagcccagctcagcttctcttcctcctgctactctggcctccagttcagactaccgacggagagtattgtgttagacacacgtcctccacgccctacccttgttctttacgtcctaccggaaggggaaacncgccctaccctctccgtcgcgacgggcctaggtacaaggtagtcggttcggccgttccgttacgtaacgtccgtacggtaaacccaaaccgaaccaaaaccgttcggggacccacgggtaccctaccccggtaacggccccccttacgacttaccgtaaggttcggtacgacccttaactaccccgaaacggtcgggaccctaacgtccgggactaaccgtcccgacgtaccgttacggttacgaggtcggacgtagggtacgggtaagtcggggaacaggttaccttaccgtactaccgacaccctagtactaacgtcgacgtaccggtaggacctacgacgtaagtcgttggtacgtactttaaggtttacttacgtactaccaacgttacggttacccgtacgggtcggttaccggggtacccccgggttaccgggggttaccccttaaccgggtttccccgggtaaccgggttaacccggggtaaacgtaaaccgggttcggtaaacgttaaccgttaaccggaaacggttaacgggtcggttacggacccgttaccgaaccgttaccgttaattcccggtaccgtttccttacgtttaaccccgg

SEQ ID NO: 262880 - DNA, 829 bp, Homo sapiens
  misc_feature: GYAE6OF01C3V99.8.33.C11.1.454.CMB.1.raw
tcagctcgcgtgtccacgaccggtgctcgatttagagtgagctcgtgggagaggagcccagcactagaagtcggcggtgtttccattcggtgatcagcactagaacacgagagacctcaccagtggtgttggctaggtacgttcgggttttcctcgttgtctttacgtttaaggagttcgtaccgagttgtacaagtcgacgtaacgtgggtaggtacggtcgggtgggggagtcgtacgtccgaggtccggtagggacgttacacgaaggaacgtccttccgtcgtggtacgaccgtacggttcccgttccggttcgggttaacccttacccgtttagaacggtacggtaccgtaaccggtctaaggttcggaccgttaccgggttaccccgggtaaccccgaaacccgtaaaaccggttccggaaacgggtcggtaaaaggggtcggtttaggggagggttcgggtacgtacgtttaggtttcgtacgacgttcggaggtacggtcttaggttacgtaagaggttcgtagtcgacgtacggccgtacggaggtacggtcctacttaccacctctaccgacgtaaggaaccaaccgtacctaaccgaaagtaactactagtttacgtaccgttaacggaactacggtaacctacggttacgtaccgacgtaacgggacggttaaccggtacggttacttaacgttacgtaacgggaacgggtacggggaacggggtaaccgggaacgacggggtacgttaccgtaaacggttaccgttcgtaccggtacgggtaccggtacggtacccgggccgttaccggtacccgg

SEQ ID NO: 262881 - DNA, 570 bp, Homo sapiens
  misc_feature: GYAE6OF01BA8QB.8.33.C11.1.454.CMB.1.raw
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctaccgagggggaaaacgcgcccaccccttctccctgcagggcccagtcagaattgtggcgccttgaagcgtgtaccaacacaaacctgccagcctcccaggcccctcatctatggtgcatccaacgcgggccacgtggcactcccagccgaggttcagtggcaggtgggtatggggacngacttcgactctcacntcactcagcctggacgctagaacgngtgttagnttagtttatactntacaactattccgggtactacggtacggcccggtccgggggtcccctacgtttcccggcccgtacgggacccgtaggtcgggacgtactacgaaccgtactggtcgcgtcgctaccatactcgttctcgtacg

SEQ ID NO: 262882 - DNA, 774 bp, Homo sapiens
  misc_feature: GYAE6OF01B1NAQ.8.33.C11.1.454.CMB.1.raw
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
tcagctcgcgtgtccacgaccggtgctcgatttagagtgagctcgttgggtttgggggaggaactgctcagttaggacccagagggaaccatggaagccccagctcagcttctcttctcctgctactctggctcccagtttcagataccgaccggagagattgtgttgacacagtctccagccaccctgtctttgtctccgaggggaaagcgcccaccctctcctgcagggccagtcagatgtgcncttgagctgtaccaacacaaacctggccaggcctccacggcccctnatctagtggtncactccaacgcgggccacgtggccactcccgagcctaggttcaggtcggacgtaggttcggggtagtcggggaactacgtaccttacaccttaccgtaccaacccgtattaccaacgtacgacggtcccgtagggaaccggtcccgttaggtaaacgtagttttacggtttacggtaccgtttaaggttttttaacttaaccgtttacggtaaccctaaaccgttacggttacccgggttaaccgggtacggttacccggggtacccccgggtttaccccgggggggtacccctttaacccgggttttccccggggtaccccggttaccgggggtaacccggtaaacgggggttcgggaaaccggttaacggtaacccggtaaaaccgggtaccggttacggggttcgggacccggttacgaacccgtacccgtactttaccggttacgttccctttaccgttaacccccg

SEQ ID NO: 262883 - DNA, 1060 bp, Homo sapiens
  misc_feature: GYAE6OF01DSQGE.8.33.C11.1.454.CMB.1.raw
  modified_base (178)..(178): a, c, t, g, unknown or other
  misc_feature (178)..(178): n is a, c, g, or t
tcagctcgcgtgtccacgaccggtgctcgatttagagtgagctcgttgggtctgggagaggagcccagcactagaagtcggcggtgtttccattcggtgatcagcactagaacacagacggactcaccagtggtagtttggctgtacgttggttttcctcgttgtcttacgtttaagnggtcgtccgtagttcgtacgtaaggtgaccgtaacggttgggtacgggtacggttcggggtagggggtacggtccggtacggtaccgacggtcccgggtaggggtacgtaccgaacgtaacggtaaccgtacccgttccgttcccggtaggtaccgtaccgtaccggttcccggtttacggttaccggttacccttaccgttaacgtacggtaccgtaccgtacggtacgtacgtaccggtaccgtaccggtacccggtaacccaaccgtaaccggtaccggaacggtaacggtaagggttaggttcgggtacgggttcgggttacgttacggttttacgttcggttacgtacggttacggtacgggtacggtacgtttaggttaacgtttacggtaagtttacggtacgtacggtaccggtaccgggtaacccgggtacgggtaaaccggtaaccgggttaccttaacgttaccccgtaacggttacccgtaaccgtaaccggaaaccggtaaaccgtaaacccgtaacccggtaaaccggtaaaccgttaaaccgttaaacgtttaaccggttttaaccggtttaaccggttaaccggtaaccggttaaccgtaaacccggttaacgttaacccgggttaacggtaaccggttaacgggtaaaccgggttaacggttaacggttaaccgtaacgtttaaccgggtaaacggggtaaaccggggtaaacgggggtaaaccggggtaaccgggggtaaacccggttaacccggggttaaccgggttaaacccgtttaaacccggttaacccggttttaaccggtttacccgggtaaccgggtttacccgggttaacccgggggtacccgggttaaacccggg

SEQ ID NO: 262884 - DNA, 797 bp, Homo sapiens
  misc_feature: GYAE6OF01EFX0T.8.33.C11.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
  modified_base (173)..(173): a, c, t, g, unknown or other
  misc_feature (173)..(173): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagctcgcgtgtccacgaccggtgctcgatttagagtgagctcgttgggtctgggagaggagcccagcactagaagtcggcggttgtttccattcggtgatcagcactgaacacagaggactcaccatggagtttggctgaacttgggttttccncgttgcttnttttaagnggtgtccagtgtcaagtgcaacgtggtggagtcgtgggggagcgtagtccagccgtgggacgtcacgaganacctctcctgtanccagtcccttgtcgggttccacccgtttgacggttcgccgttacggctagtcggacctacggttcggggaccccaaccgtaaaccgttccggaaggggtaccgtaaagggggtacttttggggaagggtttcggggtcgtaccgttaggtttttcgttacgaacgttccggtagggacgggtcttaaggttccgttaagaaggttcgggttatcggtaccgtaggaaccggtcccggttaagggaacccggggtcccttacgttaccgaacccgttattccccgaacgtaaggaaccgtaacctaaccgtacccgaacggtaactaacgtaagtttcgggttaacttacgggacctaaggtaaccgacggttaacccgttaacggtcccgtagggtacgtaaccggttcggtataacgttaccgttacggtacgggtaaacgggaacgggggtaccggggtaaccaggggtaccggttaaccgttaacccgaaccggtttccttaccggtttaggaccggttccgggtcggggtaacccg

SEQ ID NO: 262885 - DNA, 1017 bp, Homo sapiens
  misc_feature: GYAE6OF01A9AZQ.8.33.C11.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaacttgggttttccncgttgcttcttttaagnggtgtccagtgtcaagtncaacgtggtgagtcgtgggggagcgtagtccagccgtgggagtcagagagtactcctccgtgtgcacgtcctgttcgggttcctaccgttcgagtacgtccgtacggctaatcggacctacgtccggggtacccaccaaaccgtccgaaggtaccggaagggtacgtttacggggacgggttggggtacggtaccgttagggttttacgtttccgtacggttccggtagggtaacgggacgtttaacggggtttaccgtttaccggtaaaggtttcgggttaaacgttcgggtcccggttaaccgggtaaccccggggttacccgggttaaccggggtaaacccgggttacccggttaacccgtttaacccgtaaccccggtaaccgtttaccccgtaacccccggtaaacggaaacccggttaaccccgtaaacccggtaacccggtaaccggtaaacccgtaaacgttaaaccgtttacgggttttaaaccggtttaccgggtaaaccccgttaaccggtaaaccggtaacccggttaacccggttaaacccggttaccggttaaccggggtaaaccggttaacggggttaaccggggtttaacgttaaaccggttaacccggtttaaccggttaaacgggggttaaacccggggtaaaacgggggggttaaacccgggggggtaaaccgtaaaccgggggggttacccgggttaaaccggtttaaaccccggtttaaaaccgggtttaccccggttttaaccccgggtttaccgggtaaacccgggttccgggggtttaacccgggggttaaccccccggggg

SEQ ID NO: 262886 - DNA, 750 bp, Homo sapiens
  misc_feature: GYAE6OF01DRXOK.8.33.C11.1.454.CMB.1.raw
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (570)..(570): a, c, t, g, unknown or other
  misc_feature (570)..(570): n is a, c, g, or t
tcagctcgcgtgtccacgaccggtgctcgatttagagtgagctcgtgggagaggagcccagcactagaagtcggcggttgtttccagttcggtgatcgagcactgaacacagacgactcacagtggtaggtttggctagtacgtttgggtttttccctggttgtacgtttacgttttaaggcggttcgtccgtagttggtacaaggtgtaccgtaacggtgggtacggtaggttcgggtagggggtagtacgttacggcccgaggtccggtaggggacggtaccaaacggtacggacgtccttccgtcggttgcgaccgtgttccttacggttcggttcctacgttcgagtacgcgtacgntaggtcnccgtacgtcggtaccacctaacggcgaaggagaggtagttggnggttcggattcgtagttcgttacngtcggtggaggtctaggttcgtataggtgtntacgngtacggacgtcggaggacggtctagtccactcgttacgacggaataccgaaccgtaacgtacgaaaccgattaacgagttttcggtaacttcccggaanacgttaacgcggttaacctcggtcggaaccggaacgggtaccgttacgggttaactttacgaaccgggttaaggttaaccggggaagggtaaaccgggggtacggaacccggtggtaaccggtaccgttcgaagttaccgtttcgaggtaccggtggaccgggtccgttaccggtaccgg

SEQ ID NO: 262887 - DNA, 763 bp, Homo sapiens
  misc_feature: GYAE6OF01BAY9Y.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgtctccgaggggaaangccaccctctcctgcagggccagtcagatgttggcnccttgaanctgaccaacacaactggccagcctccagccctnatcatggcgcactaccaacgcgggccacgtcggaccactccccgagtccgtaggttcgaggtcggacgtagggtagggtacgtacggggaactacggtacctttaccgaccgttcctaaccaaccgtataccgaacttacccggacgtacccggttagggtaacctacccggttaagtaacgttacgtttacggtttaccgtaaccggtttaagtttttaactaccgtacgtaacccaacggttccgtaccgggttaaccggcggttaccccgggtaccccggggttacccgggtacccgtttacccgggttccccgggaccggttaaccgggggaaccgtaaggggttccggtaaaacgtaaccggttaaaacccggaaacgggttacccgttggggtcccctaaccggtaccgtacccctaaaccgtttaccgtttacccgttacccgtttcccgttaacccgtttaacccccgg

SEQ ID NO: 262888 - DNA, 691 bp, Homo sapiens
  misc_feature: GYAE6OF01ESNS7.8.33.C11.1.454.CMB.1.raw
  modified_base (456)..(456): a, c, t, g, unknown or other
  misc_feature (456)..(456): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagatgttggcgtcttgtaagctcggtaaccaacaaccaaacctcggaccacggcctcccgacggcccctctatctagtggtcgcaactcccgaaacgcgggaccacgtcgccactccccgagaccgtaggttccaggtcggcgtagggtggggtatggggaactacggtacttacactctacacctatcactcacggtcctgggacgtccgtagaaagtnttcgttagtacgttagttttaacttacgtacgtacctaaacgttacgtccgtaacggtacgggtcccgggtccccgggtacccgggggtaccctttaccgggtttcccgggacccggttaaccggggaaccggtaacggggtaccggtaaggtaaccgtaaaccggtaaaccggtaacgttcgggttacggaccgtacgaccctaccgtacttccgtcgttccttaacctacccg

SEQ ID NO: 262889 - DNA, 834 bp, Homo sapiens
  misc_feature: GYAE6OF01CTACW.8.33.C11.1.454.CMB.1.raw
  modified_base (217)..(217): a, c, t, g, unknown or other
  misc_feature (217)..(217): n is a, c, g, or t
  modified_base (331)..(331): a, c, t, g, unknown or other
  misc_feature (331)..(331): n is a, c, g, or t
tcagctcgcgtgtccacgaccggtgctcgatttagagtgagctcggttggggtttgggggaggaactgctcagttaggacccagagggaaccatggaagccccagctcagcttctcttcctcctgctactctggctcccagtttcagactaccaccggagagtattggtgttgacacagtctccagccacctgttctttgtcctccgaaggggaaanacgcccaccctctcctgcgacgggccagtcagaatggttcggcgtccttacggtaagtcgtaggtaaccaacaacgaaaccgtcggaccacggtccctacccgacggcccctanactcgtagtcggtacgactacctaccgaacggacggacctacgtcggacctaaccgttaccccgaacgtccccggtaagggttaccgacgggttacggaccggtaagggtttacgggggtaacggttaccgggggaacttaacggtacccgttaaccgtacccgttactaacccgtaacctacgttaactactaccggaccgtcccgttaagggacgtaccgtaaggtaacgtaagttcggttattaacgttaagttttacttacgttaccgtactaaactacggttaccggtaacggaccgggttccgggtaccccgggtacccggggttcccgttaaccggtttcccggaaccccgggttagggaacccgggttaaggggtaccggtaaacgtaaccggtaaccgtaaaaccggggtaacttcggggacccggttacgtaacccggcccgttaaaccgtactttaccggttaccctttaacccgttccgtttaaaccccgg

SEQ ID NO: 262890 - DNA, 905 bp, Homo sapiens
  misc_feature: GYAE6OF01BDW9B.8.33.C11.1.454.CMB.1.raw
tcagctcgcgtgtccacgaccggtgctcgatttagagtgagctcgttgggtttgggagcccagcactagaagtcggcggtgtttccattcggtgatcagcactgaacacagaggactcaccatggagtttgggctgaacttgggttttcctcgttgcttcttttaagaggtgtccagtgtcaagtgacaacgtggtggagtcggtgggggagcgtagtccagccgtgggagtcacagacgacctcctccgtgtcgcgacgtcccttcgttcggggttcctaccctttcgaaggttacgtccgtaaccggctaagtcgacctacgtccggggtaccccgacccgaaaaccgtcccggaacgggaccggtaaaggggtacgtttacggggaggttgggggttaccggtacggttaggtttttcgtttaccgtaattccggtagggaacgggtacgttaaggtttacgttaacgtaaaggttcgggttatcggtacgtacggtaccgggtaccggtagggtaaccggggtcctacgttacccgaaccgtacgttcccgtaaccgaacggtaaccgtaaacccgtaaacccgtaacccgaaacggtaaacccaaacgttaacgttacggtttaacgtttacccggaacccttaacggaacccgtaaccggtacccgttaacggtcccgttaaggaaccgggtaccggtaacggggtttacttaaaccgttaacgttacggttaacgggaaacgggtaacggggggtaaaccgggggtaaacccgtaagggggtacccgggttaacgttaacccggttaaacgggttacccgtttacccggtttaacgggtacccgggttaccggtaaccgggggtaccccggttaaccggggttaccccggtacccggg

SEQ ID NO: 262891 - DNA, 822 bp, Homo sapiens
  misc_feature: GYAE6OF01BC8M8.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggtagtttgggctagaacgttgggttttccctcgttgcttcgttttaagaggtgtccagtcgtcaagtgctaacgtggtggagtcggtgggggagcgtagtccagccgtgggagtcacgagagacctcctccgtgtcgcacgtccttcggtacgggttcctaaccgtttcgaagttacggaccgtaccggactagtcgaccgtacggtccgggtaccccaacccgtaaaacctcccggaaggacggtaaggggtgtttgggagggtgggtcgtacgtagtttcggttacagttacgtgggtacggtcgtaggttagttacgaagttggtagtcggtactcgggaacgtccggtaggaacggtcctaacttccgaacctacgttcccgtaaccgacgtaaccgaaacctacccgtaccgaaacggaaacctaacgttaattaccgggtttaatttaccgggaaccttacggaactaaccggtaacccgttaacggttacccgagggaacggtaaccgggttaacggtttaacgtaacgttaacgttaagggtaacgggttaaacgggggaaaccgggaaaccgggggtaaccggtaaccggggttaacgggtaaccggtttaaccgtaaacggtttcccggttaaccggttagggacccggttagggtacccggggtacccggttaacccggggtaccccgg

SEQ ID NO: 262892 - DNA, 826 bp, Homo sapiens
  misc_feature: GYAE6OF01ACIWG.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacttgggttttcctcgttgcttcttttaagaggtgtccagttgtcaagtgcaacgtggtggagtcgtgggggagcgtagtccaggccgtgggaggtcacgagagacctctcctgtgctacgtccttcgttgggttaccaccttgaaggtacgacttaacggctagtcgctaccggttcggggtaccccacccaaacgtccggaacggaccggtaaaggggtagtttcggggaaggttggggtacggccgttaggttttgtttccaaggttccgtagggacggggtctaaggttcgttacgtaaggttggtaacgtgtccgtagggacccgtacgggtaggaacgggtcctacttaccgaccgttacgtccgtaccgaaggaccgaacccgtaaccgtaccgaacggtaaacctacgtaagtttacggttaaccgttacggaacccgttaacgaaacccgtcgtaaccccggtttaagtaccccgggtaagggaccgggttaaccggtacgggtttacttaaccggtaacccgttaacggtaccggggtaaaccggggtaaagggggaacccggggtaaacggcggggttaacccggggttaaaccgtttacccggtaaccgtttaccgttcccggttaacgggaccggttacccggggtacgggggttacccgttaccggggtacccccgg

SEQ ID NO: 262893 - DNA, 766 bp, Homo sapiens
  misc_feature: GYAE6OF01AJZFQ.8.33.C11.1.454.CMB.1.raw
  modified_base (137)..(137): a, c, t, g, unknown or other
  misc_feature (137)..(137): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (728)..(728): a, c, t, g, unknown or other
  misc_feature (728)..(728): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccngtttcagataccaccggagagtattgtgttgcacagtctccacgcccacctgttctttcgtctccggaaggggaaagacgacccaccctctccgtagccgagggcccagtcgaagtaagtgttggccgtccttacgtaacgcgtacgtaaccaacaacaaaccgtcgaccgacggtccctcccaccggccccnctactctagtggtacncactaccaacgacggcctacgtcgacaccgtaccacgtccgtacggttcgaggtacggtagtagggttagggtaggacggtacgtacgtacttaccgtactcctaccgacctagtacacgtaccgtacgtaccgtacggtaccgtcgtaagtaaggttacgtacgtttacggttactttacgtttttaaccttacggttacggttaacctaacggtttaaccgttaaccgggttaacccgtccgggttaccgggttccccgggtaaccggggttccccgtttaacccggtttcccgggtaacccggttaccgggtaacggtacgggtacggtaaacggtaacctaaaccgggaaaccgttacggtcgggtacggtacccgtntaacccgacttactaccggtttaccttagttacgtccc

SEQ ID NO: 262894 - DNA, 1096 bp, Homo sapiens
  misc_feature: GYAE6OF01DUM7U.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacgagaggactcaccagtggtaggtttgggctgtaacgttcggggtttttcctcggttcgtctttacgtttttaaggagggttcgtacccgtaaggttcggttaccaaaggttcggaccgtaaaccggttggggtagggaacggttccgggtaggggggacggacgtttaacggcccgaggcccgttaggggacggtaccaacacggacgtaccttcgtccgtggtcggaccacggtccttcggttgggttaccctaaccgttcgaacggttacgacgtaaccgggtctaacgttcggaccaacggtttccgggtaccccggaaccctaaaaccgttacccggaacggaaccgggtaaacgggggttacggttaggggtaacgggtttgggggttacggtacgtttaagggtttttcggtttaccgaagtttcggtacgggtaaaccggggtcttaagggtttacgttttaaccggtaaaggtttggggtttaacgttcgggtaccggtaccggtaaacccggggtcccgggttaaaggggtaaccgggggtaccccctttaaggtttaccccggtaaccctaacggttaccgttaaccccggaaggttaaacccggaaaccttaaacccggacccgaaaagggtaaacccttaacgtaaaacgttttcggtttaaacggttttaccgggaaacccttaacgtaaaccggtaccgttaaacccgggtttaaccgaccggttaaacggggttaaaccgggaacccgggtttacggggtaacccgttttaaacgtaccggttaaaccgggttaacggggtaaaaaccggggaaaccggggggtaaacccgggggtaaacccgggtacggggtttaacccggggttaacccgtttaacccgggtaaaaccggtttcccggtttaccccggttaaggtaccccggggtttaaccgggttcccggggtaaccccggttaacgggggtttaaccccg

SEQ ID NO: 262895 - DNA, 901 bp, Homo sapiens
  misc_feature: GYAE6OF01DK9EL.8.33.C11.1.454.CMB.1.raw
  modified_base (379)..(379): a, c, t, g, unknown or other
  misc_feature (379)..(379): n is a, c, g, or t
  modified_base (438)..(438): a, c, t, g, unknown or other
  misc_feature (438)..(438): n is a, c, g, or t
  modified_base (571)..(571): a, c, t, g, unknown or other
  misc_feature (571)..(571): n is a, c, g, or t
tcagctcgcgtgtccacgaccggtgctcgatttagagtgagctcggttgggtttgggggaggaactgctcagttaggacccagagggaaccatggaacgccccagctcagcttctcttcctctgctactctggcctcctagttcagactaccgacggagagtattgtgttagacactagtcctccacgccctacccgttgttctttcgtaccgtaccggaaggggaaacaccgccccgtacccttccttccgtgaccgtacgggacctagttaccaaggtacgttggttcggccgttaccgttacgtagtccgtacggtaaacccaaacgaaccgtaaaccgtcggaccgtacgtaccctacccgaccggtacccctanacttcgttaggtcggtacaccctacgtaccgaacgccgggaactacgtacggcctaccncccgagtaccgttacgggttacgaggttacggacggtaagggttagggtaacggtcgggaactaccggttaacctacgtacccttaccgtaacctaacggtactacgacgttaccgaacgtccgtaacggggnttacccgtaaggtaacgttacgtttacggttacgttaaccggtttagttttaacgtaaccggttacgtaaacccctaaacggttacggtttacccgggttaaacgggtcccggtacccggggtaccccgggttaccccgggttaccgtttaaccccgggtttcccgggaaccgggttaaccgggaaaccgggtacggggttaaccgaacggttaaaaacccgttaacccggtaaaacgggttccggttaaccgggcgttaacccggtaaccgtaccccgttaaacttcggtttaacccgttcccgtttaacccgttacgttaaccccccg

SEQ ID NO: 262896 - DNA, 770 bp, Homo sapiens
  misc_feature: GYAE6OF01D4GCO.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacttgggttttcctcgttgtcttacgttttaagaggtgtccagtgtcaagtgacaacgtggtggagtcggtgggggagtcgtagtccgagtccgtagggagtcaacgagacgtactctccgtgtcgccagtcctcgttggttacctaccgttcgagtacgccgtacggctatcgcctacggtccgggtacccaaccgtaaacgtccgaagggacgtaagggtagttcgggaggtcgggtgtacgttaggtttcgtttacagttcgagggaggctaggttcgtactagttggtatcgctacgggacgtcgtaaggaacggtctaacttacaccgtactccgtaccgaagtaaccgtaacaaccgtaccggaaaagtacctagtttaacggtttcggttaaccgtttacgaacccgttaaggtaaacccgttaccggtaacgtttaaccggttacggacggaaccgggttaacggttaccggtttagttaacttacccggttaagggtaaaacgggttaaacgggacggggggtaaaccggacgtaacggggttaccgggtactttaaccggtaacgtttccgtttaccggttaggacccggtttacggggaccgggtaaccggttcgggtaccccg

SEQ ID NO: 262897 - DNA, 850 bp, Homo sapiens
  misc_feature: GYAE6OF01AVFSI.8.33.C11.1.454.CMB.1.raw
  modified_base (214)..(214): a, c, t, g, unknown or other
  misc_feature (214)..(214): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagactaccaccggagagtattgtgttgacacagtctccagcccaccctgtctttgtctaccgaggggaaancgcccaccctctcctcgcgacgggcctagtcgaagtaacgtggttcggaccgtccgtttacggtaagtcgttacggtaacccaaaccaaccaaacccgtcggaccgacggccctacccgaccggtccccctcaccttccttagtcgggttcgacacgttacccgaaacggaccgggtacccacgtggaccctaccgtcccgaacggtcccgtacgggtttccgagggtacggaccgtaagggggttaggggttaacggttacggggaaacccgtacggttaaccgtttaccccgaaccgtttacccttacccgtaaccctaacttaccaaccgttaccgtaccggtacccggttacggggtaccgtacccggttaaggtaaacggttagtttcggtttacggtacgtttagttttaaccttaccgttacgttacctaaactacgttaccgggtaaccggttccgggtccggttccccgggtcccgggggtaccctttaccggtttcccgggaccccgggtacggtaaccggtacggggtacgtaacggtaccgtaaccgaaacgttacggtacggttcggccgtaccggtacctaacccggttacgttaccgttcccgttagttccgttaaccccg

SEQ ID NO: 262898 - DNA, 688 bp, Homo sapiens
  misc_feature: GYAE6OF01CI7Q8.8.33.C11.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
tcagctcgcgtgtccacgaccggtgctcgatttagagtgagctcgtgggagaggagcccagcactagaagtcggcggtgtttccattcggtgatcagcactgaacacgagagactcaccagtggagtttggctgaacgttgggttttcctgttgcttcgttttaagnggtntccagtgtacaagtgacaacgtggtggagtcggnggggagcgtacgtccgagtccgtgggagtcacgagacgtacctccgtccgtggtcgacgtacgtccttacggttcggttacctaccgttcgaggtacgccgtacggcagtcgacctcggtcggacccaccaacgtcgagtacgagggtgtggnggtggntcgtgttcgtnagttgagngtctagtgtacagtgatcgacgtacggaccgacgtaggaccgtctataccaccgtatcccgaacgagaaacgacttaaccgacgaacgtaacacgttaagtcggttacgtaccgtaacgacgaaccgtacgttaaccgtacggacgtaacggacgggtaaccgtaggttaccttaaggttacccgtaagggtacgggaaccggggaacgggtaacgggacgtacgggttaacggtaccgtttaagacccgtacgtttaccgtacggtccgggttaccggtacccggtacccggtaggttaccccg

SEQ ID NO: 262899 - DNA, 711 bp, Homo sapiens
  misc_feature: GYAE6OF01ERE76.8.33.C11.1.454.CMB.1.raw
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagcccacctctcctgcagggccagtcagatgtgcgcttgagctgtacaacacaaccgtgccagcctccacggccctnatctatggtcgcatccaacgcgggccacgtcggccactcccgagccgaggttcaggtggcgaggtgggtagtgggactaggtaccttcgaccgttctaccaccgtatacacttcgacgtcccgtacgggacgtacccgtaggtaaacgtcgttacgggttactacgtttaagggttttaactttaccgttacgtaacccttaaacgttacgttaacccgggttaaccggtaacgggttcccggggttaccccgggtaccccggggggtaccccttacccgggttttccccgggaccccggtttaccgggggaaacccgttaacggggtacggtaaccggtaacgtaccgtaaaaccggtacggttacgggtcggtaccgtacgaacgtaacccgtattaccgttcgtttcccttacgtaccccgg

SEQ ID NO: 262900 - DNA, 571 bp, Homo sapiens
  misc_feature: GYAE6OF01EG5WV.8.33.C11.1.454.CMB.1.raw
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (287)..(288): a, c, t, g, unknown or other
  misc_feature (287)..(288): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (317)..(318): a, c, t, g, unknown or other
  misc_feature (317)..(318): n is a, c, g, or t
  modified_base (376)..(376): a, c, t, g, unknown or other
  misc_feature (376)..(376): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccgaccggagagtattgtgttgacacagtctccagccaccctgttcctttgtcctccgaaggggaaanacgcccaccctctcctgcgagggccagtcagatgtgctcttganctgacacacaacngcngctccngccnntctatggtcncactacagcggacngcgcnnccagctaggtcagtgacgtaggtggtagaggacatactcactcacacactcacgtacngccgtgacgcctagaagtattgtatacttagtttactctagactaactacgtaccggtacgtcggtccggtaccggtccgggtaccttaccggtcggtaccgtacgggaccggtaaggcggtaacgtacgtaacgtaaaccggagttaggtccgggtataccgactaccgtacgttacgttctcgttcgttaccg

SEQ ID NO: 262901 - DNA, 711 bp, Homo sapiens
  misc_feature: GYAE6OF01BCU4Y.8.33.C11.1.454.CMB.1.raw
  modified_base (142)..(142): a, c, t, g, unknown or other
  misc_feature (142)..(142): n is a, c, g, or t
  modified_base (157)..(157): a, c, t, g, unknown or other
  misc_feature (157)..(157): n is a, c, g, or t
  modified_base (165)..(165): a, c, t, g, unknown or other
  misc_feature (165)..(165): n is a, c, g, or t
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagctcgcgtgtccacgaccggtgctcgatttagagtgagctcgtgggagaggagcccagcactagagtcggcggtgttccattcggtgatcagcactgaacacagagactcaccatggagttgggctgactgggtttccncgttgctctttaagngtgcagtntcagtgctatggtggatcgtgggggancgtagtccaggcctgggagtcacagacgtacctntaccgtgtcncaggtcctcgtcggttcaaccgtttgaggtacgctaacgggcctaagtcggacctacgtccggggtaccacccgtaaaacgtccgaagggtacctaagggggtattcgggacggttcggggtgaccgttaagtttcggttacagtttccgaggacggtcagttcgtactaagtgtacgtcgtcgtagaccgngttaacggacgcctagtaccgactntaccgcgngactacaccttaccggaagaaccacgtagttacgtagtttacggacctaggaactaccggaccttacggttaccgacgggtaaacggttacgaccgggtttaatacgtaaccgtaccggttaacggtaacgggtaagggggtaaccccgggtaagaccggggtacggtaacgtttcccggaaacggtttcccgtttaacgttacgtacccgggttaggttaccccgggaccgtcccgggtttaaacccgg

SEQ ID NO: 262902 - DNA, 844 bp, Homo sapiens
  misc_feature: GYAE6OF01DOEX6.8.33.C11.1.454.CMB.1.raw
  modified_base (146)..(146): a, c, t, g, unknown or other
  misc_feature (146)..(146): n is a, c, g, or t
  modified_base (178)..(178): a, c, t, g, unknown or other
  misc_feature (178)..(178): n is a, c, g, or t
tcagctcgcgtgtccacgaccggtgctcgatttagagtgagctcggttgggtttgggggagaactgctcagttaggacccaggagggaaccatggaacgccccagctcagcttctcttcctctgcctactctcgcctcctagtttnaagacacccgacggagagtattgtacggttanacaactaattcccgaccaacgtccctaccgtttagttcctttaccggtcaaccgggaaagggggaaataccgccccctacccttccgtaccgtggaaccggtacgggaccctaaggtacgtaaaggaacggtttcgggttccgggaccgttacccttaaacgggtttaccgtcccgttaagggaaaccctaaaaccggaaacgtaaaacccgcggaaccgtaacggtcccgacccgtaaccgccctacgtactaccgtagttacggacaacctaccgtaaccgaaacggacccggtaaccacgttaccggacctaaccgtacccgaaccggtaccgtaacggggttcaacggggttacgacggtaggttacggggagaacgggtacctacggtacttacctacctacgacctaacgtaccagtaccgtacgacgtcgttacggaacggccgtaggaggtacgtacgttacgattttaacggtttataccgtaagaacctaacgtagttaaacccggtggtaacggtccgggtaccccggtacccgggttaccgttcccggtttaccggaaccggtacgggaacgtaaggttacgaacttaacggaccgtaaagacgttaggtcgtcgactaacccggtacttacgttacttccgttagttccctcg

SEQ ID NO: 262903 - DNA, 695 bp, Homo sapiens
  misc_feature: GYAE6OF01BXFIA.8.33.C11.1.454.CMB.1.raw
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (476)..(476): a, c, t, g, unknown or other
  misc_feature (476)..(476): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgaccaaactccaggacaagggattggagtgggtggcagttgtttcatctggagggcagtgttcaatggtatgctgacgcgtgaagggccatcacatctcagagacactccagacacatgtattgacctgaacngcctagtctggacgacacggtntaatctagtacgtacggaaagggacgggggaaccagggtcgggtaacgtttaccaaaggttacctttaccgtttacggaaccggtcggtacgggggaccctaacggggttaccccgtagggtccctacccggttctcccgtacgaccgtccctacccgaaccgacggaccctacggttcccggttcccttcccccggngggcccgtccccgtagtccccgtaccggacggtcccgaccgttacccgacggaacgccgaaccaccgggtaccggcccgggtccgtggccctacgggtccggtacggtaacggtaaccggttaaccttcccgtacccggaacgtcccgggtatacggtccggtaacgggccgggtaccgggcggtaacggacccggaggcccgtaaatgaccgtncgnc

SEQ ID NO: 262904 - DNA, 841 bp, Homo sapiens
  misc_feature: GYAE6OF01A6EFX.8.33.C11.1.454.CMB.1.raw
  modified_base (205)..(205): a, c, t, g, unknown or other
  misc_feature (205)..(205): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagactaccgaccggagagattgtgttgacacagtctccagcctaccctgtctttgctaccgaggggaanacgccacccgtctcgtcgccgagggccagtccaggtacgttacgttaccaccgtagtacgcctaggtaacccaacaaccgtaaaccgtcggaccgtacggcctcccgacggtcccctagtacttcttagacttagacctacgtacctagttccggaccgggaccacggtccgacctcgttacccccgagcccgtaacggttcgaacggtcggtaccgtagggttcgggtaccgttaggggaactacggtacctttacccgtctaccgttaccgaaacctcgtaccgacgtaccgaacccggtacgttaacggacccggtccgtaaggttaaacgttttagttttaccgtaacttttaagtttaactttaacccggttagttaaccttaaaccgtaccggttcccggttaaacgggtccggttaccccgggtacccgggttaccccggggaccgtttcccggtttaaccccggggacccggtttaacggttaaaccgtaaagtaccggtacgttaacggttaaacccgaaacccgggtttagtaccgggtacccggtagtacccggttaccaaccccggttagttacccgtttacgttacccttaccgttaacccgttccccgtttaccccgaaccc

SEQ ID NO: 262905 - DNA, 869 bp, Homo sapiens
  misc_feature: GYAE6OF01CGBFO.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggacctcaccatggagtttgggctgaacttcgggttttcctcgttgcttacttttaagaggtgtccagtgtcaagtgactaacgtgggtggtagtcggtgggggaggcggtacgtccgagccgtgggacggtcacgagtacgacctctccgtagtcgaccaggtccttcgttcgggttcctaccgtttcgaacggtacgccgttacgggactacgtcgtccgtaccggtcggggtcccgaaccctaaacgtaccggaacgggacggaaaggggttacggttaggggtacgggtcggggtacggtacgttacgggttttcgtttaccaggtttacggtaggtaagggtaccgtaaggtttcgttaacggtaagttggttaacgttcgacccgtttagggacccgggtaccgggtagggtaacccggggtacccgttctaacccgtaaccgttacctacccgtaaagaacgtaaccgtaaccctaacccggtaacccgaacggtaaacccgtaaactacgttacgtttacgtttacgggaaacctaacggtaccgtaacgttcccgtaacgtccgtagggtaaccgtaacggttacggttacgttaacgtaccgtacgtaagggtaaccgggtaaacgggggaaccggggggtaaactccgggggtaaccggttaaaccgttacccgggtaaacgtttaccccggtttaggtttacccggcggggttaacccgggtaccccgggggg

SEQ ID NO: 262906 - DNA, 767 bp, Homo sapiens
  misc_feature: GYAE6OF01BNY25.8.33.C11.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttagaccactagtcctccaagcccacccttgttcctttcgtcctaccggagggggaaacncgcccacccgtctaccnggtcacgggccagtaccaggaacttggttcgacgtcctttcgaaggtcctacggtaccaaccacgaacccttggcccaggccctccgacggcccctanatctagtcggtcacaacgttaccaacggtacgggcctacgtcggacctacctcccgaacgtccggtacggtctacgggtacggacgtagggcgggttagacgggaactaacggtcttaccactcgtaccaccttagcctaactcgacgtacggtcgaacgtctacgtaacgtcgtacggttacgactttaacggtttacttaccgtagtaaccgtactacgttaaccgggtacggtacggtaccgggtcccgggtttacccggggggtaccctttacccgggttcccgggtacccgggttacgggaaccggttacggggtaacggtaacggtacgtaaacccggaaacgttaacggttacgggtacgttacccgacgggttacccgaaaccgtttcgtaccctttacggttacccttcgtaacccg

SEQ ID NO: 262907 - DNA, 895 bp, Homo sapiens
  misc_feature: GYAE6OF01E2UB9.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctcgaacgttgggttttcctcgttcgtctttacgttttaaaggaggttgttcccgtagttcgttacaaaggttgactaaacggtgggttaggacggttcgggttagggggggacggtcggttacggtcccaacggtcccggttagggggaacggttaccaacgaaggtacgtaccttccgttcggtaggtcgccgtacgtcccttacggttcgggttccaaccctttacgaaacgttaaaccgtaccggtactaacgtacggtaccgtaccgggttaccggggtccccgaacccgtaacgtccgttaccggaacggtaacggaaacggggttacgttacggggtaacggggttcggggtacggtaccgtttaaggtttttcgtttaacgtacgttcggtaggggacgggtcggtaacggtttagttacgtaaggttcgggtagtacgaccgtaacggtacccggttaccgggttaaggaaccggttacccgtacttaccgaacctcgttaccgtaaccgaagtaacgtaactaacggtacgaaagaacctaagtaagttaggtagtttacggacgtagtaaccgacgtaacgtaccgttacggtacgtagggaaccggtacgtaccgggtacttaacgtaaccgtacggtaacgggtaaaccgggaacggggtaccgggtaaccgtacgggacggttaaccgtaccgttacgttaccgttaccggttacggacccggttccggtacggggtcccgttaaccggg

SEQ ID NO: 262908 - DNA, 818 bp, Homo sapiens
  misc_feature: GYAE6OF01AT4FN.8.33.C11.1.454.CMB.1.raw
tcagctcgcgtgtccacgaccggtgctcgatttagagtgagctcgtttggggtttggggtctgggagaggagcccagcactagaagtcggcggtgtttccattcggtgatcagcactgaacacagaggactcaccagtggtagtttgggctggtaaccttgggtttttcctcgttcgtctcgttttaagaggtgtccagtgtcgaagtgcaacgtggtggaggtcgtggggggacgtcgtagtccgagcccgtgggtacggtcacgaggagaccttcctccgtgtcgccgacgtcccttcgttcgggttccaacccgtttcgaaggttacgccgttaaccgggctacgtcggccaaccggttccggggtaccccgacccaaaaccgttccgaagggtccgaaaggggtacttggggtaggtggggtcgtaccgtaggtttcgtttacagttccgtaggacgggtctaggttgtttacgaagttggtacgtcggacgtacggaccgtccggtaggaacgggtcccgtacgttaccgaaccgtacttcccgtaccgaaggtaaccgtaaccgtaaacccgtaccgaacggtaaacccaacgtaaacggttacgttaacgtttcgggaaacccgttaacgtaaaccgtaccgttacccgttaacggtcccgttacggaacgggtaaccgtacgggttacgttaacgtaacgttacggtacggtaaaccgggaaggggtaacgggggaacccgagggtaccgggtaacgttacccgtaaacggttaccttacggtttccggtaacggttccggtaccggggg

SEQ ID NO: 262909 - DNA, 777 bp, Homo sapiens
  misc_feature: GYAE6OF01D0KD5.8.33.C11.1.454.CMB.1.raw
  modified_base (219)..(219): a, c, t, g, unknown or other
  misc_feature (219)..(219): n is a, c, g, or t
  modified_base (527)..(527): a, c, t, g, unknown or other
  misc_feature (527)..(527): n is a, c, g, or t
tcagctcgcgtgtccacgaccggtgctcgatttagagtgagctcgttggggttgggggaggaactgctcagttacggacccagagggaaccatcggaagccccagctcagcttctcttcctcctgctacgtcctggctcccagtttcagactaccacggagagattgtgttgacacagtctccagccaccctggttctttcgcgtccgaagggggaaanacgcctacctcgtaccgtcgacgacggcctagtacgagaagttcggttcggaccgtcctttacggtaacggcgtacggtaaacccctaaacaacgtaaaacccggtcggacccgtaacgggccctacccgaacggcccccctttagacgttacccgtaattcgggtaccgactaaccgtaccggaaaacgtccgggccttacggacggacgtaacctccgaacgtcccgaaggtttccgaggtcggtacgaacggttgggtaacacgggaactaaggtaccttacgacttcgactaaccaattcgaanccgtaacgcctaggacctaccgtaagaaagttcgttacggtacgtaacgtttagttttaacgttacgtacgtttacaacgttagttaccggaacggtcgttccggggacccgttacccgggggtactttacccggtacggtccggacggggttaacgtacgggacggtaaactaccggtaaggaaaaccccggtaggttcggtaaccggtctcgacgtaccttaattccgggttacttcgttcccgtacg

SEQ ID NO: 262910 - DNA, 808 bp, Homo sapiens
  misc_feature: GYAE6OF01ERGBZ.8.33.C11.1.454.CMB.1.raw
  modified_base (761)..(761): a, c, t, g, unknown or other
  misc_feature (761)..(761): n is a, c, g, or t
tcagctcgcgtgtccacgaccggtgctcgatttagagtgagctcgttgggtttgggggaggaactgctcagttaggacccagagggaaccatggaacgccccagctcagcttctcttcctcctgctactctggcctcccagttttcagactaccgaccggagagtattgtgttgacacagttctccacgccctacccgttgttcttttgtcctaccgaagggggaaacgacgaccctacccttctaccgtggccgaggggaccctaggtcaaggtaattcgggttcggccgtccgtttaggtaaacgtcgttacggtaacccaaaccgtaaccgtaaaaccgttcggaccgtaccgggtaccctacccggaccggtaccccctacgtaacttcgttaacgtcgggtacgaccgtaaccgtacccgaaacggtaccggggaccctaacggtcggacctaccgtccccgaacgtccgtaacggttcgacggttcggacggtaggggtggtaaggtcgggaactacggtaccttccgacttaccgtaccaaccgtatcgtacgtacgaacggtccgtagggctaccggtagaagttgtggttacgacgtttaacgtttacttacgtactaacgtaacgtacgttacggtacggtcgggtacggtcccgggtaccggggttacccttaccgggttcccggtacccggtagggtaaccggtagggtaacgtaacgtaaccggtaacgtaaccggtaggttaccggngttcccacgacccgttacgacgttttacgcctttcgtacgttacccg

SEQ ID NO: 262911 - DNA, 687 bp, Homo sapiens
  misc_feature: GYAE6OF01DHL9Z.8.33.C11.1.454.CMB.1.raw
  modified_base (239)..(239): a, c, t, g, unknown or other
  misc_feature (239)..(239): n is a, c, g, or t
  modified_base (359)..(359): a, c, t, g, unknown or other
  misc_feature (359)..(359): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctccctagtttcagactaacccaccggagagtattgtgttagacacagtctccagccctacctgttccttttgtcctaccggaagggaaaagcgcccaccctcctccngcgagggccagtcagaatggttcggcgtcgttagagtccgtagtaacccaacaaccaaaccgtggaccctacggtccctacccgaccggtcccccctatacttccgttaagtcgggtacncctacctaccgaaccggacgggtcccacgtcgacacgtcccgacgtccgtacgtcgagtcggacgtaggtagggtacgtgggtaacacgtacttcacgtccncactactcactcgacgcgtgacgntagtagnttcgtgtactagtttactacgtgtacacgtcgtaccggtactggtccggtcccggtccggggtaaccttccgggttcccggaccggtacggggtaccgtaacgggtaagtacgtaacgtaaccgtaaacgggtccgtttagggcgtaaccgtacgtcgtaaccgttacgtccgttaacttcccgtacgttacccg

SEQ ID NO: 262912 - DNA, 629 bp, Homo sapiens
  misc_feature: GYAE6OF01DMEDM.8.33.C11.1.454.CMB.1.raw
  modified_base (211)..(211): a, c, t, g, unknown or other
  misc_feature (211)..(211): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanacgccaccctctcctgcagggccagtcagaagtggttcggccgtccttacgtaagcgtggtaaccaacacaaaaccgtcggaccaggcctcccgacggtcccctacactacgttactggtacgtaccatacccaaacgacggggaccaacgtcggacacgtccacgcgtaggttcagtcgctaggtggagtgggactaggtactcactcgtacacgtatacactccgacgtccgtgacgtactaggactaagttgttcacgtagtttatacgtataccaatacgtcgtacgtaggacgtccccggtcggggccttaccgttccgggccgtaccggaacgtaacggtcggagtaacgaaccgtaaaccgaagttccggtgacgttcgactacccgtagttacctcgttacgtcctaccg

SEQ ID NO: 262913 - DNA, 658 bp, Homo sapiens
  misc_feature: GYAE6OF01DSB4A.8.33.C11.1.454.CMB.1.raw
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgaccaaactccaggcaagggattggagtgggtggctagttgtttcatctggagggcagtgttcaatggtatgctgacgccgtagacggctatcacatcncaganacacncagacanatntattgactgaacngacctaagtcngaacggacgacgggtntatactacgtaggtaacggaaggggacgggggaacngggtacgggtacgttaccgaagttaccttccgttgaccgtcgcggggcctacgggtacccgttggacctccgtctcctcacgccctaccgaacgaccggcccacggttccgtccccttccccgtcggccgtcccctggccctccggaaggtccaccctaccgtcgaacgacgacctccggaccggtcccggtcccgtcggtacccttccggtaccggttaaccggtacgaaccggtaccttaccggtaccccgaacgtaacccgggccgaacggtctacggggtccgggaccggggtcgtacgggaaccgaaggggcccctagttaaacggtgnngngtg

SEQ ID NO: 262914 - DNA, 756 bp, Homo sapiens
  misc_feature: GYAE6OF01A3RYI.8.33.C11.1.454.CMB.1.raw
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
tcagctcgcgtgtccacgaccggtgctcgatttagagtgagctcggttgggtttgggaggaactgctcagttaggacccagagggaaccatggagccccagctcagcttctcttctcctgctactctggctcccagtttcagactaccgaccggagagattgtcgttagacacagtcctccacgcccaccctgttcttttcgtctccgaaggggaaanacgcccaccctctcctgcacgggccagtcagatggttcggcnccttacgagcgtacggtacaacacaaccgtggccaggcctaccgacggcccctcatcctagtggtcacactaccaacgacgggtcccacgtcggactaccgtaccgacgtccgtaaggttccaggtcggacgtagggtacgggtagtacggggactaacggtcttaccgaaccgttctacccgaacctacttaccgaacttacgacgtacccgtagggaccgtaccgttaaggaaacgtagtttcggtttagacgttttaacgttttaacttacgttacgtaactaactacggttaccggtaacgggcggtaccgggtccccgggttacccggggtacccttttaccgggtttacccgggccccggttaacggggttaaccgacggggttacggaaacgttaccgtaaaccgtaaacgggtacgttacggggttccgaccgttacgacccgttaacccgttagttcccgtttacgttaccgtttcccgtaacccgg

SEQ ID NO: 262915 - DNA, 1079 bp, Homo sapiens
  misc_feature: GYAE6OF01BDHKK.8.33.C11.1.454.CMB.1.raw
tcagctcgcgtgtccacgaccggtgctcgatttagagtgagctcgttgggtttgggggaggaactgctcagttaggaccagagggaaccatggaagccccagctcagcttctccttcctcctgctactctcggcctccctagtttcagactaccgaccggagagtattgtgttgacactagtcctaccagcccacccttgttctttcgtctaccggaaggggaaacacggaccccacccgttcctccgtcggaccgacgggccaagtaccgaaggtaacgttcgggttccggcccgttaccgtttaccggtaaacggtccgttaaccggtaacccaaaaccgaaaccctaaaacccggtcgggacccgtaaccggtcccctaccccggacccggtccccctactacgttccgttaacggtcggtacgaaccctaaccgttaaccccggaaaaccgggacccggggtacccttaaccgggtaccggtaaccccttaacccggttaccccggaacccggtaaccccgggtttaaccgggtttaccgtaaccgggggtaggggtaaccggttacgggggtttaacggggggtttaacggaaccgggggtaaccctaaaccggggtttaccctttaacccggtaaacctttccccggaacccctaaaccggaactttaccgaaccgttcgaacccgggttacccgggtaccggggtaaccgttaacccgtaagggttaaacggttagtttaccgggtttaacgttaaccgttttttaaacggtttttaaccttacccggtttaaacgttaacccggttaaaccgggttaacgtttaaccccggggttacccgggttaacggggtcccccgggggtttaacccccggggtccggggggttaacccccttttacccgggttaccccggggttaccgggtaaccccgggggaaacggttaacggggtaaccggtaacgttaaacccggaaacccggttaaaccgggttaaccggtcggggttacggtaccctccggaccgtaacccttacgtttaaccgttacctttcccgtaacggttaaccccc

SEQ ID NO: 262916 - DNA, 738 bp, Homo sapiens
  misc_feature: GYAE6OF01A6AU1.8.33.C11.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (280)..(281): a, c, t, g, unknown or other
  misc_feature (280)..(281): n is a, c, g, or t
  modified_base (292)..(292): a, c, t, g, unknown or other
  misc_feature (292)..(292): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagactaccaccggagagattgtgttgacanagtctccagccaccctgtctttgtctccgaggggaaancgccaccctctcctgcaggccagtcanagtgtgctcctganctgacacacaactgcagctccagcccctnntctagtggtcnctactccgaacgcgggcccagtcggacctcgtaccccgaagcccgtagggttcacgggtcggcctaaggggttacggtacgtaggggaccacggttaaccctcgaacttccgtaccaaccgtactcaactcgtaacgtccgtaggacgtacccgttaggaacgtacgttcgttagtaccgtttagtttaacgtttacgttacgtacaaccgttacgttaccggtaccggtaccggtaccgggtccccggtacccggggttacccgttacccggttttccgggaaccccggttacggggtaacccgtacggggtacgggtaaaccgtaacggttaaaccggaaacccggtaacggtttcgggtaacccgggttaccgtaccggggaaccccttaacccggttactttaaccggttaccgtttacccgttttaccccgttaaccccgg

SEQ ID NO: 262917 - DNA, 703 bp, Homo sapiens
  misc_feature: GYAE6OF01B4VHZ.8.33.C11.1.454.CMB.1.raw
  modified_base (381)..(381): a, c, t, g, unknown or other
  misc_feature (381)..(381): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccgaccggagagattgtgttgacgacagtctccagcctaccctgttctttgtcctccgaaggggaaagcgcccaccctctcctgcgacgggccagtacagtaagtcggtttcggccgtccttacggtaagtccgtacggtaacccaaccaacctaaaacccgtcgggacccaaggtccctacccgaccggtacccctctacgttcagtgggtcacactaccgaacgcgggaccnggtcgcactccacggcctaggttcaggtcggacgtgggtaggtacgnggtacagtaccttacnccgtctaccactatcgtactcgacgtcccgtggacgtccgtagtagtacgtagttcgtactttaggtttactcgtacgtaacctaaccgtaggtttacccgtaacggtcggtccggtaccccgggttccgggggtaccccttacgggtttcccggacccgggtagggacccggtaaggggttacgacgtaaccggtacgaaaacggttgtcgggtcggacttccggacgtaaccttcgtcttacgtccttcgtaacccg

SEQ ID NO: 262918 - DNA, 653 bp, Homo sapiens
  misc_feature: GYAE6OF01A1UA4.8.33.C11.1.454.CMB.1.raw
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagctcgcgtgtccacgaccggtgctcgatttagagtgagctcgttgggtctgggagaggagcccagcactagaagtcgggcggtgtttccattcggtgatcagcactgaacacagaggactcaccatggagtttgggctgaacttgggttttcctcgttgcttcttttaagaggtgtccagtgtacaagtgcaacgtggtggagtcgtgggggagcgtagtccaggccgtggggaggtcaacgagacgctctctgtcgcagtcctgtcgggtacctaccttcaggtcgctacggcatgccacggtcgggtcccaccaaactcgaggtcgaggngttgggagtgggngctaggttgttacntcgtaggacggtctaggttcgttagaagttgggtatcgcggtggaccggtccggtagggaaccgggtcctacgtccacctcgtcctaccgaagacgaccaactaccgaagaacctaacgtacgttagttacgttacggacctagaacctacgtacccgttaacggtcgtaacggtaggaaccgtagggtactaacgtacgtacgtagggtaacgggaacgggggacgggacagggtaccgggtacttaccgtaacggttcctaccgttgacccgggttgggtcgggtaccg

SEQ ID NO: 262919 - DNA, 869 bp, Homo sapiens
  misc_feature: GYAE6OF01B4M97.8.33.C11.1.454.CMB.1.raw
tcagctcgcgtgtccacgaccggtgctcgatttagagtgagctcgttgggtttgggggaggaactgctcagttaggacccagagggaaccagtggaacgccccagcctcagccttctcttcctcctgctactcgtcggcctcccagtttcagactacccgacggagagtatttgtgttagacactacgtcctccacgccctacccgttgttactttcgtccgtaccggaaggggaaacgccgccctaccctcgtcctgaccgacgggcctagtacaagtagttcggttcggtcctaccgtttacggtaacgtccggttaacggttaaacccaaacccgtaaaccgaaacccggttcgggaccccgaacggtcccccgttaacccggaccgtaccccccttacgttaaccgttccttaacgggttcggggtaccaacccttacgtaaccccggaacggtaccggaccctaacggtccggaccgtaaccgtacccgtacggacccgttaagggttccacggggttacggacggtacgggttaggggtagtaccgggtactaaccgttaccggtactacccgtacttaacccgaacttacgtaccgaagtcccgtaacggtaaccggttaacgaccgttaacgttaaggtaacgttttcgttacgtacgttttagtttacgttaaccgacgtaacgtaactccggttacgtaacggttacgggtcccggttaccgggtcccgggttaccttaccgggttcccggaacccggttggaaccttaggtcgtaaacttacgaaccgtaaacgtcgttaggtaccgcttaccgacccgtagttcttacggttcctctttaaccgcccgtttaccccg

SEQ ID NO: 262920 - DNA, 766 bp, Homo sapiens
  misc_feature: GYAE6OF01DUSJ0.8.33.C11.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagtattgtgttgacacagtctccagccacctgtatttgtctccgaggggaaancgcccacccgtctcctgcgagggccagtcagatgtgcgcttgagctagtaccaacacaaccgtgccaggcctcccgacggccccctnactctagtggtcgctacgtaccgaacgacgggcctacgtcggaccactccccgacgaccgtaggttcgacggttcggacgtagggttacgggtaggtacgggacctaacgtacccgtttccgacccttactacccgaaccctagttaccgtaacttccgaacgtcccgtacgggtacgtacccgtaggtaacgtaggtttacgttcggtactttaacgtttttaacgttacgttacggttacctaaacgtacgtttacccggtaacggtaaccgggttccgggtaccccggtttcccggggggtaccctttaccgggtttaccccgggtacccggttacggggtaaacccggttaacgggtacgggaaccgtaaccgtaaaccggtaaaacccggtacggttacgggtacggtacccggtacgtacccgtaccgttactttccggttacgtttccgttaccgttacccg

SEQ ID NO: 262921 - DNA, 923 bp, Homo sapiens
  misc_feature: GYAE6OF01EXYBN.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaagacgcccaccctctcctgcgagggccagtcagaagtggttggcgtccttacgtaagctacggtaccaacaaccgaaaaccgtcggacccacgggccctacccgacggccccctacacttactagtcgggtacgactaacgtaccccgaaacggaccggggtacccaaccggttcgggaccctaaccgttaccccccgaacggtaccccggtaacggggtttcccaacgggggttacgggaccgtaacggggtttacgggggttaacgtacggggggaaacccgtaacgggtaaccctttaccaacccgttacccttaaccctaacccgtaacttaccgaacttacccgaaccggtacccgttacggggacctaacccggttagggaaacgttacgtttacgggtttacgtaccgtttaaggttttttaaccttaaacggttccgttaaccgtaaacgttaaccggttaccgggttaacccgggtacgggttccccggggtacccccggggttcccggggggtaaccccgtttaccgggtttacccccggggtaccccgggttaaccgggggtaaacccggtaacgggggttacgggaaccggtaaacggttaaaccccggtaaaacccgggtaacgttcggggtaaccggggtacctaccgggacccgtaaaccgttaccgttacccgttacgttttccccgtactttaaccccg

SEQ ID NO: 262922 - DNA, 912 bp, Homo sapiens
  misc_feature: GYAE6OF01EFO23.8.33.C11.1.454.CMB.1.raw
  modified_base (229)..(229): a, c, t, g, unknown or other
  misc_feature (229)..(229): n is a, c, g, or t
tcagctcgcgtgtccacgaccggtgctcgatttagagtgagctcgttgggtttggggaggaactgctcagttaggacccagagggaaccatggaacgccccagctcagcttctcttcctcctgctactctggcctccctagtttcagactacccgaccggagagtattggtgttcgacacctagtcctccacgcccacccgttgttctttgtcctccgaaggggaaacncgcccaccctctcctgccgacgggccagtccagtacgttcgttacccaccgtagtttacgaccttaggtaaccaacaaccgaaaccgttcggaccctacggccctaccccgaacggtcccccttacgtacgttccttttagactcgacctaccttccgaagttcccggaacgggtcccaacgtccggactaccgtaccccgacgaccgtacgggttcaggtcggaaccggtggtcggggttccgaggggaaccgtacggtaccttaccgaccgttctaaccgaacctgtaccgacggtacgaaccgtccgtaacggacgtacccgtaagtaacgtttacgtttacgaacgtttaaccgtttattaccggtaacgtaccgttaaaccgtcgtttaaccccgggtaccggttaacggggttcccggggtacccccgggtttacccgggggttaccccctttaacggggttttcccccgggtaaaccccggttaaccggggtaaaaccccgtttaaaagggtttccggaaaaccgggttaaccggttaaaacccccgggtaaaacggttacccgggttttaccggtacgggttaccccgtacccgggtaacccccttaaaacccgggttcgttttaacccggttaacccgttttcccttaaacccggttcccgtttaaccccccgg

SEQ ID NO: 262923 - DNA, 683 bp, Homo sapiens
  misc_feature: GYAE6OF01EJDG0.8.33.C11.1.454.CMB.1.raw
  modified_base (207)..(207): a, c, t, g, unknown or other
  misc_feature (207)..(207): n is a, c, g, or t
  modified_base (406)..(406): a, c, t, g, unknown or other
  misc_feature (406)..(406): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccatccacctgtctttgctccaggggaaancgcccaccctctcctgcgagggccagtcagaatgtgcgccttcgaagctggaccaacgacaaaccgtggccaggctcccacggcccctcactctagtggtgcactccaacgcggccacgtggcactccagccgagttcaggtggacgtaggtacgggtagtggggactaacgtacttacaaccgtcctacaaacccctntacctataccgacggtacccgtaggggacgtacccgtaggtaaacggtacgttggtttacgtaccgttaaaggtttttaacttacgtttaggtaccctaaactacgttacccggtaacgtaacgggtccggtaccccggggttacccggggtacccttacgggtttccccggccggttaccgggaacccggtagggtacggtacggtaacgtaccgaaaacggtacgtcggtcggaccgtcgacccgtacctagttaccttcgttccttacgtaccc

SEQ ID NO: 262924 - DNA, 837 bp, Homo sapiens
  misc_feature: GYAE6OF01CMZGA.8.33.C11.1.454.CMB.1.raw
  modified_base (457)..(457): a, c, t, g, unknown or other
  misc_feature (457)..(457): n is a, c, g, or t
tcagctcgcgtgtccacgaccggtgctcgatttagagtgagctcggttgggtctgggagaggagcccagcactagaagtcggcggtgtttccattcggtgatcagcactgaacacagaggactcacctagtggtagtttggctgacgttgggttttcctcggttagtcttacgttttaaggaggttcgtaccaggttcgtacaaggttcgacctaaacgttgggtagggtaggtcggtaggggggagtccgtaagtccctaggcccgtaggggacgtcaacgtagtaccgtaccttcgttcgtggtacgccgtacggtcccttcggttaaccgggttcctaacccgttttacgagggttacggtacccgtaacgggtcctaacgtcggtaccccttacggtccggggtaaccccctaaccgaaaaccggttccggaagggtaccggtaaaggggttntttacgggggaggttcggggtacgttacgttaaggttttcgtaccgtagttcgtagggtacggtcgtagttcgtaatagggtcgtagtccgtcggttaggaccccggtacggtagggaaccggtctacgtccaccgtattccgacacggtaacgaacctaacgccgaacgaactacgtagttagttacgttacgaaccgtagtaacgtctaaccgtaccggttagcggtaaacgccggttaggtacttaaacacggttacggtaaacgggaccgggtaaagggggccgggtaaccgggaacggttcgggtaaccgttaacgtaccggtttaaacccgtcggtttaaccgggcccggtttagggccccggggtaaacccgg

SEQ ID NO: 262925 - DNA, 948 bp, Homo sapiens
  misc_feature: GYAE6OF01D77N5.8.33.C11.1.454.CMB.1.raw
  modified_base (217)..(217): a, c, t, g, unknown or other
  misc_feature (217)..(217): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagtattgtgttgacacagtcctccacgccacccttgttctttgtcctccgaaggggaaanacgcccaccctctcctgccgagggccagtcaagtagttggtggcctccgtttacgagtccgtacggtaacccaacaacctaaaccgtcggaccgacggccctacccgacggtccccctatacgttccgttaagttcgggtcacctaacgtacccgaaacggtaccgggaccctacgtcgggacctaaccgtccccgaacggaccgttacgggttccgaacggggttcggacggtaggggttacggggtaggtaaccggggaacctaacggttaaccttacccgtaccgttaccctaacctaacccgtagttacctaacgtccgtaccggtcccggttacgggaaccgtaccggtaaacggtaaaggttcggtttacgggtttaccgttaacgttttaaaccgttttttaacgttaaccgtttaccggttaaacctaacccggtttacggttaacccggttaacccggggttacggttccccgggggttaccccccggggttacccggggggttaaccccttttaacccgggggtttcccccgggtaaccccggggttaacgggggtaaccccggttaaaaggggttacgggtaaaaccgtaaccgggtttaaaacccggtaaaaaaccggggtttcggttacggggttaccggtaccggtaaccccgtaaccccgttaacccgttacgttaccggttttacccgttttcccgtaccctttaaacccccggg

SEQ ID NO: 262926 - DNA, 614 bp, Homo sapiens
  misc_feature: GYAE6OF01E5MO3.8.33.C11.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (464)..(464): a, c, t, g, unknown or other
  misc_feature (464)..(464): n is a, c, g, or t
  modified_base (568)..(568): a, c, t, g, unknown or other
  misc_feature (568)..(568): n is a, c, g, or t
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
tcagctcgcgtgtccacgaccggtgctcgatttagagtgagctcggttgggtttgggaggtcacagagactctcctgtgcagcctctgggttcaccttcagtagctacggcatgcacgtgggtccgaccaaactccaggcaagggattggagtgggtggctagttgtttcatcgtggaggcagtgttacaagtggtatgctgacgcgtagaaggcatcacatcncaganacacncagacanatntatgactgacngactagtctgagacacggtatatactacgtagtaacggaagggacgggggaaccagggacgggtacgttaccgaagttaccttccgtttggaccggtcggtacggggtaccgtaacggggttacccgtggtacctacccgttcctccgtaccgacgtcccctaaccgaaccgaaccgggtccctcgttacccggttcccttcccccggnggtccccgtcccgtacgacccgtacccgaggccgaccacccgtacgacgacgccaacggcgtccggccgtgggcctcgaccgtggacaacgtctacgtccgacncgcgacgcgtggcgacggtgtcggacgacggcgacagagnngnacg

SEQ ID NO: 262927 - DNA, 617 bp, Homo sapiens
  misc_feature: GYAE6OF01DZCJN.8.33.C11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcnctgagctgtacacacaactgccagctccagcccctnatctatggtcgcataccaacgacgggccacgtcggcactcccagccgaggttcaggtggcgaggtgggtagtgggacacgtacttcactctacaccatacatcagccgtggacgtcctagacgtagttgttacgacttaaggttttattacgtacgtaactaactacgttccggtacgacgggtccgggtccccggtacccgggggtaccctaccggttttcccgggacccggttacggggaacccgtaaggggtacggaacgtaccgttaaccggaaaacggtaacgttgggtccgacgtcgaccgtacctagttcgtacttcgtaccttacccg

SEQ ID NO: 262928 - DNA, 868 bp, Homo sapiens
  misc_feature: GYAE6OF01AZP9V.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagactaccgaccggagagagttgtgttcgacacagtcctccagccctacccgtgttcctttcgtacgtacccgaagggggaaagaccgcccaccctcctccgtcgcgacgggccagtacagtaattggttcggccgtcgttacggtacgcgttacggacctaaccaacctaaaccgtcggaccgacggtacccgtacccgaccggcccctcgtacgtttccgtttcgggccctttaccgtttaaacggaccgggtaccgtaacggtacgggtaaacctcccgacgtacccgtaggtaccggacgggcggtacggtagggttccggggtccggttaggggttacccgtttcggttacccacgtttccccgtactaaccctaacgttaacctaaacgttaacccctgtaacccgtaagttcccgtaaaccggttaccgttaccgtttcgggtaacttttaacggtttttactttcccgttgtaaccgtaaccggtacgtacgggttctaaagggtactccggttacccggttccgtttaaccggttacgggttacccggggtacggggtaaccggtaaccgtaaccgggtaccggttaaaccgtacccggtaaagttaccggtgggttaccggggaccttaccggtaaccgccttacttaccggttacttaccgttaacccttcccgttaccccgttactacccgtaacgttcgaaccggtaacccgg

SEQ ID NO: 262929 - DNA, 910 bp, Homo sapiens
  misc_feature: GYAE6OF01EN0ZO.8.33.C11.1.454.CMB.1.raw
tcagctcgcgtgtccacgaccggtgctcgatttagagtgagctcgttgggtttggggagaactgctcagttaggacccagagggaaccatggaagcccctagctcagcttcgtcttcctcctgcctactctggcctccagtttcaggacttaccgaccggagacgtatttgtgttgacgtactagtcctccacgcctaccgtgttcttgtctaccgaagggaaacgcgaccctacctcgttaccgtcgacgacgggtcctaacggttcgaagtaacgttggttccggtccgttaccgtttacggtaacgtccggttaaccggtaacctaaaccgtaaccgtaaaccggttccggaacccggtaaccggtaccccgttaacccgtacccggttaccccttacgttaacgtttaccggttaacggttccgggtaccgtaaccgttaaccgtaaacccggtaaccgggtaccgggtaccctaccgggttacggaccgtaacccgtaccggtaacgtaccggtacggttacgtacgggtcgtacgtacgggtacggtacggttacggaacgtaccgtaccttaccgtaccgttacccgtaacgtacctacgtacgttaacgtaccgtaccgtacggtacgtaaccgttacgtaagtacgttacgttacgttacggttaactttacgttttaaccttaccggtaacgttaaccgtaacgttaccggtaaccggttacggttaccggtaccggttacccgggtaccggttccggttaccggttccgggtaccggtacgggtaaccgtacggtaacggtaccgttaaccggtaaacgtcggttaacggttacggtaccggtacgttacgtaacccggttactacggtttacccgttcgttaaccgttccgtacccgg

SEQ ID NO: 262930 - DNA, 942 bp, Homo sapiens
  misc_feature: GYAE6OF01CGG39.8.33.C11.1.454.CMB.1.raw
  modified_base (683)..(683): a, c, t, g, unknown or other
  misc_feature (683)..(683): n is a, c, g, or t
tcagctcgcgtgtccacgaccggtgctcgatttagagtgagctcgtgggagaggagcccagcactagaagtcggcggtgtttccattcggtgatcagcactgaacacagaggactcacatggtagtttggctgaacgttgggttttcctcgttgcttacgtttaagaggttcgtccagtgtacaagtgacaacgtggtggtacgtcggtagggggacgtcgtaacgtccgacgccgtagggtacgtacaacgagacgtacgtcctccgtgtacgccgtacgtccgttcggttcggttaccctaccgtttacgaaggttaccgtaccggttaaccggctacgtacgtaccgtaaccggttccggggtaaccccaacccgtaaaaccgtccggaacgggtaccggtaaaggggttattagggggacgggtttgggtacggtaccgtttaaggttttccgttactacggttcggtacgggaacggggtctaggttacggtttaagaaggttggttaacgcggtacgtacggacccggtacggtaagggacccggttaccgtactttaacccggaccttacgttaccgaaccgaacggtaacccgtaaacccggtaaccgtaaccggaaaacggtaacctaacccgttaaggtttccggtttaaacgtaccgggtaaacccgttaanaaaccccgggttaacggttaccctaaccgggttaaccgtaacgggtaacccgggttaaccggttacggtttaacgtaaccgttaacccgggttacggtaacggggttaaaccgggggaccgggttaaaacgggggacccgttacggggaaccggtttaaacccgttaccggttaaacggttaccccgttttcggtaaccgggttacccggtttaacccggggtccgggtaaacccgggttccccgtttaacccccgggg

SEQ ID NO: 262931 - DNA, 762 bp, Homo sapiens
  misc_feature: GYAE6OF01DFK5L.8.33.C11.1.454.CMB.1.raw
  modified_base (151)..(151): a, c, t, g, unknown or other
  misc_feature (151)..(151): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
tcagctcgcgtgtccacgaccggtgctcgatttagagtgagctcgtgggagaggagcccagcactagaagtcggcggtgtttccattcggtgatcagcactgaacacagacggacctcaccatggagtttgggctgacgttgggttttccngttgccttattttaaggaggttcgtccagttgtcaagtcgacaacgtgggtggagtcggtgggggagcgtagtccgagccgtgggagtccagagagctcgtccngtgcagcctgngtacttcctaccgttnagtacgctacggcagtcgctacggtccggccaaccaaacctcggaacggacgaagggtagttcgggtaggtcgggtacgacctttaaggttttcgttaacgagttcgtaagggcggtactagggtttacgttaacgtaggttgttacgtcggacgtacgggtacccggtacggttaagggtaaacccgggtccttaacttacccgacgtaaccgttaccgtaccggaagaaccgtaccaaccgtaccgaacggtaacctacgttaagttacgttaacgttcggaacctaggaacctacgtaaccgtaacgtccgtaaggacgtacggtcggttaattacgacggttaacggtagggtaaccgggaagggggaaccgggtaaaccgtaggggtacccgggttaaacttaaccccggaagtttacccggttcccgtttaagggacccggttacccgggttaccgggccggttaaaccccggg

SEQ ID NO: 262932 - DNA, 734 bp, Homo sapiens
  misc_feature: GYAE6OF01A1CAX.8.33.C11.1.454.CMB.1.raw
  modified_base (167)..(167): a, c, t, g, unknown or other
  misc_feature (167)..(167): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (408)..(408): a, c, t, g, unknown or other
  misc_feature (408)..(408): n is a, c, g, or t
  modified_base (624)..(624): a, c, t, g, unknown or other
  misc_feature (624)..(624): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacgttgggttttcctcgttgcttcttttaagnggtgtccagtgtacaagtgctaacgtggtggagtcgtgggggagcgttagccgagccgtgggacgtcacagcgactcctccgngtcnctagcccgttgttcgggttccacctttacgaggttacgcctaacggctatcggacgtacgtcgggtacccgaaccaaacgtcccgaagggtaccgtaaggggacgtttggggacgttggggtaccgtattaggttttcttacgaagtttccggngggaacggtcgtaagttggtttaaccgaaggtttggtaacggttcgcgttaacgggacccggtacgggtacggaacgggtccttaatcccgtacctcgtactaccggagaacccgacgttaaccgaccgtaacgaaactagtttacgtaggttaagttacccggtactaagaaccgtcgtaaccggttagaccggtaggaaccggtcgttaacgtntaacgttcgacgttaacgggtacggaacgggggtacggaacgttcgacgggtaccttaaccgtagttccgtacgtttcgggacgtttcgacggggcccttaggtccccgg

SEQ ID NO: 262933 - DNA, 842 bp, Homo sapiens
  misc_feature: GYAE6OF01ARH9V.8.33.C11.1.454.CMB.1.raw
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagctcgcgtgtccacgaccggtgctcgatttagagtgagctcgttgggtttgggggaggaactgctcagttaggacccagagggaaccatggaagccccagctcagctttctcttcctcctgctactctggcctccctagtttcagactaccgacggagagtattgtgttgacacagtctaccgacgcctacctgttctttgtactaccgaaggggtaacaccgcccaccctctaccgtgccgacggccagtcaggtacttcggtacgtccgtaccttacgtactaccggttacgtacctaaactacctaaccgcgggtaccacggtaccctcccgtaacggcccccttcacttccgtaggttggtaccgactacgtaccgaacgtccggtaacncggtaccgactaccnccgtaaaccgtcctagggttacgacggttcggaccgttaagggtcggttaaggtcggaacccgttacgtacccggttactaccccgtttaccgttacaaccccggttatacgtaacgtcgtacccgggtacttcggggacctttaccgggagtaaacgttcggtacgtttaccgtaaacgtttagtttaaccgttaaccggtacctaaccgttaacgttacgtacccggttaagggaccggttccgggaccccggggttacgggtcccccggtttacgtaccccgggtttacccgggggtaaacccggtacgggtaccggttacggaaacgggttaccgaaaacccggtttaccggaccggttacgggtaccggacggtaccccgtaaacctccgtaaccgtttactccgttaaccggtcttaaccccgg

SEQ ID NO: 262934 - DNA, 912 bp, Homo sapiens
  misc_feature: GYAE6OF01BPARC.8.33.C11.1.454.CMB.1.raw
  modified_base (182)..(182): a, c, t, g, unknown or other
  misc_feature (182)..(182): n is a, c, g, or t
tcagctcgcgtgtccacgaccggtgctcgatttagagtgagctcgtgggagaggacgcccagcactagaagtcggcggtgtttccattcggtgatcagcactgaacacagaggactcaccagtggtaggtttgggctagtaacgtttgggttttcctcggttgtcctttacgttttaaaggnggttcgtacctaggtacgtactaagtcggactaaacggttgggtacgggtaggttcggggtaggggggacggtaccgtacggtaccggacgggtaccggttagggggaacggtaccaacggtaaggacgttaccgtccgttaccgtggtcggccgtaccgtccccttaggttccggttaccctacgttacgtaggtaacgtcgtaccggtctaacgtcggtaccgtaccggtaccgggtaacccctaaccgtaaaccgtcggaacgggtaacgaaacggggttagtggggtaaggggttacggtcgttaacgggttcgttttaggttacgtacgtaccgggttaagggtccggggtaacttacgggtttaagttaacgtaaaggttcggggtttaactcggtaccggtaacggggtaccgtacggggtaaacggtcgggtaccgttattaccccgaaccgttaccgtacgtaacccgtaacggtaaactaacccgtaaccgtaaccggaaaccggtaactaactaagtacggtttaccgtaacgtaccgtaacgacgttaccgaaccgttacgtacgtacgggaactaaggtaccgttataacccgtatacgggtaacggaaacgggtacggggaaccgggtaacgaccgggtacggttaaactccggtaacgttccgttaaccggtacggttacgggtacccggtcgggttaacccggaggttccccgg

SEQ ID NO: 262935 - DNA, 669 bp, Homo sapiens
  misc_feature: GYAE6OF01AFPDX.8.33.C11.1.454.CMB.1.raw
  modified_base (211)..(211): a, c, t, g, unknown or other
  misc_feature (211)..(211): n is a, c, g, or t
  modified_base (358)..(358): a, c, t, g, unknown or other
  misc_feature (358)..(358): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaanacgcccaccctctcctgcagggccagtcagatgttcggctccttgtaagctcggtaaccaacacaaaccgtggccaggccctcccgacggccccctcactctagtggtcgcactacccaacggacgggccacgtcggcactccccgngccgtaggtcaggtcgcgtaaggtgggtagtcggggactacggtaccttcacttccgtaccaccgtataccactcgacgtacccgtgggacctccgtaagtaagttacgtggttacgacgtttaacgttttagtccgtaacgtacctaacgtacgttacccggtacggtcggtacccggtcccgggtacccggggtccttacccggtttccggacccggtacgggaaccggtagggaccggtaacgtaccgtaacgtaacggttacgtggtccggcgtacgacctacgtcttcgtcgttcctaacgtcccg

SEQ ID NO: 262936 - DNA, 782 bp, Homo sapiens
  misc_feature: GYAE6OF01CO2R2.8.33.C11.1.454.CMB.1.raw
  modified_base (178)..(178): a, c, t, g, unknown or other
  misc_feature (178)..(178): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (715)..(715): a, c, t, g, unknown or other
  misc_feature (715)..(715): n is a, c, g, or t
  modified_base (737)..(737): a, c, t, g, unknown or other
  misc_feature (737)..(737): n is a, c, g, or t
  modified_base (763)..(763): a, c, t, g, unknown or other
  misc_feature (763)..(763): n is a, c, g, or t
tcagctcgcgtgtccacgaccggtgctcgatttagagtgagctcgttggggtttggggaggaactgctcagttaggacccagagggaaccatggaacgccccagctcagcttctcttcctcctgctactctcggcctccctagtttcacgactaccacggagagtattgtgtgacacngtcctccacgccctaccttgttctttcgtccgtaccgaagggggaaacgcgccctacccttccgtccgngacgacgggcctagtacaagtagtcggttcggccgtccttacggtaacnccgttaacgtaacccaaacaaccgtaaacccgtcggacccgtacgggtccctacccgaccgtacccctactacttaccgtaggtggggtaccacgtaccgtacccgaaaggcccgggtaccgaacgtcgaacctaaccggtcccctaaccggtcgtacggttccgtaacgggtcggaagggtacgggtggtaacggtcgggactaacgtacttttccgaccctcgtaccaacgtaactacccgtagacccggttacggtaccggtacgggtacccgtacggttaagaacgttacggttacgtttacgtagttaacgttttataccctaggtaaccctagttacgtaccgttacggtcgtacccggggtcccggtaccgggtcccttacgggtcccgtacccggtggaaacgttacgggngtaccgtacgaaccgtaacggnggtcgtccgcgtagaccttacccgtnttagtcttccgtccttccg

SEQ ID NO: 262937 - DNA, 798 bp, Homo sapiens
  misc_feature: GYAE6OF01EUCS6.8.33.C11.1.454.CMB.1.raw
  modified_base (168)..(168): a, c, t, g, unknown or other
  misc_feature (168)..(168): n is a, c, g, or t
  modified_base (532)..(532): a, c, t, g, unknown or other
  misc_feature (532)..(532): n is a, c, g, or t
  modified_base (646)..(646): a, c, t, g, unknown or other
  misc_feature (646)..(646): n is a, c, g, or t
  modified_base (731)..(731): a, c, t, g, unknown or other
  misc_feature (731)..(731): n is a, c, g, or t
tcagctcgcgtgtccacgaccggtgctcgatttagagtgagctcgtgggagaggagcccagcactagagtcggcggtgttccattcggtgatcagcactgaacacagaggactcaccagtcggagtttcgggctcgaacttgggttttcctcgttgcttcgtttaagnggtcgtccagtgtcaagtgcaacgtggtgaggtcgtgggggagtctagtccagctagggagtaccagagacgactcctccgttagcggactacgtcccttcggttacggttaccacccgttttacgaaggtttaacgcccggttaaccggcctaagttcgtaccctaccggttaccgggtaccccaccgtaaaacctcccggaagggtaccgaaggggtacgtttggggaacgttcggggtacggtacctaagggttttctttacgacgtcccggttaggggaccggacttcgggtaacgttagtaagtcgggttaatcgggacgttacccggaccggtcccggaagggtaacgggtacccgtntttaaccccaccctaggtacctaccggaaggttaaccaccggtaaactaccggaaacggaaacccgaacgttacgtagggtttaacctttccgggaaccctaaggttaaacccncgtttaacccgaacttcccgtacgggtaacgtaccggtggtaacttaccgataaccggtcgggtaaacgagggggtaccggaaanccgggtagtcgttaaacggaccttcgtaacgttcgccggtacggtaacggtcccggccgttacccgg

SEQ ID NO: 262938 - DNA, 733 bp, Homo sapiens
  misc_feature: GYAE6OF01EFN61.8.33.C11.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagtattgtgttgacacagtctcagccacctgtctttgctcgagggaangccaccgtctcgtgcaggccagtcagatgttgctcttgaanctagtacaacgacaacgtgaccaggcctccgacgccctnactacgtagtgtcgctactaccgaacgcgggacctcgtggacctaccgtaccccgaagacccgtagggttacccgaaggttcggaccgtaggggttcgggtaacgttacggggaactaacgggtacctttacggtacccttctaacccaacgtactacggacttaccgacgtaccgtacgggtaacacccgtttagaaacggtaactttggttacaaccgtttaagttttaacgtacgttacggttaaccaacgttacggttaccgtaaccggtaggtaccgggtacccggtcccggggtacctttaccgggttacccgacccggttacgggaacccgtttaagggtaccggaataaaccggtacgtaaaaccggtacggttaggttacccggctaaccggtaccctaaaccggttcttaccggttacgtttacccgtcgtaaccccgg

SEQ ID NO: 262939 - DNA, 960 bp, Homo sapiens
  misc_feature: GYAE6OF01AYBW3.8.33.C11.1.454.CMB.1.raw
  modified_base (111)..(111): a, c, t, g, unknown or other
  misc_feature (111)..(111): n is a, c, g, or t
  modified_base (391)..(391): a, c, t, g, unknown or other
  misc_feature (391)..(391): n is a, c, g, or t
  modified_base (524)..(524): a, c, t, g, unknown or other
  misc_feature (524)..(524): n is a, c, g, or t
  modified_base (934)..(934): a, c, t, g, unknown or other
  misc_feature (934)..(934): n is a, c, g, or t
tcagctcgcgtgtccacgaccggtgctcgatttagagtgagctcgtgggagaggagcccagcactagaagtcggcggtgtttccattcggtgatcagcactgaacacgagnggactcaccagtggagtttgggctaggtacttgggttttcttggttgtctttacgttttaaggacggttctaccaggttgtacctaaaggttcgaccgaacgttggggtggtaacgggttcgggtagggggggaacgtcggttaacggtcccgaagggtcccggtaggggtacggtacaccgaaggtacgtacccttccgtccgtagtcggaccgacgttccctttacgggttcggtttaccctacccgtttagtacgggttacgtacccggtacggtanacgtttacggccgtaacggttcccggggtacccccgaacctaaaccccgtccggaagggtaccggtaaacgggggtagtttacgggggagggttcggggtacggtaccggtttaacggtttaggttttaaacncgggtttacccggttagggtacggggggttaaccctaacggggttttacgtttaaaccggtaacgggttaggtttaacgtttaccggggacggtttaacccggggtacccgggccggggtttaaaaaccggggccggggtaacccgtttacgttaaccccgtaaccgttacccggttaacccgtacccgtaacgggtaacccggtaaaccctaaacccggtccgtaaaacggtaacccgtaacgttaaacggtttcgttaaacgttcgtaacctacggaacgtaacgtacgttaaccgtacgtagggtaacgtaccggttaggtactattaccggagtacgggtaagggaacggggtaacgggacgtaccgggtacgtaacggtaccgtagttacccgtaggttaccgtntaccggtggtcccgtcggttacccgg

SEQ ID NO: 262940 - DNA, 748 bp, Homo sapiens
  misc_feature: GYAE6OF01CCO2X.8.33.C11.1.454.CMB.1.raw
  modified_base (341)..(341): a, c, t, g, unknown or other
  misc_feature (341)..(341): n is a, c, g, or t
tcagctcgcgtgtccacgaccggtgctcgatttagagtgagctcgttgggtttgggggaggaactgctcagtaggacccagagggaaccatggaagccccagctcagcttctcttcctcctgctactctggcctccctagtttcaagactaacccgaccggagagtatttgtgttacgaacacgagttcctaccagcccacccttgttcttttgctaccgaaggggtaaagcgacccacccgttcctcctagccgtagggcccagtacagtaagtgttcggcctccttacgagctacgtaccaaccaactaaccgtcgaccgacgcctccgaccgcccctnacctcgtatggtcacctacgtaccgaacgacggccaacgtcggcctacctacccgacgtccgtaacggttacgtacgggtggtaccggtaagggttagggtaacggtacgggacgtaacggtacttaaccgtactaacccttaccaacctaactaccttacgaccgtacggtaccgtaggtacgaccgttaaggaacgttaaggttcgttaagttacgtttacgttttaaacgttcttacgtaaacctactaacggttaaccggtacggtaccgggttaccgggcccgggttacccggggtaacgtttcccggtccccgggttaccgggtaccgtaaccggtaacggtaggaccgtaagtaaccgaacgtgtacgcgactcgactctcttactggtccttgtacccg

SEQ ID NO: 262941 - DNA, 721 bp, Homo sapiens
  misc_feature: GYAE6OF01BCUHH.8.33.C11.1.454.CMB.1.raw
  modified_base (178)..(178): a, c, t, g, unknown or other
  misc_feature (178)..(178): n is a, c, g, or t
  modified_base (351)..(351): a, c, t, g, unknown or other
  misc_feature (351)..(351): n is a, c, g, or t
  modified_base (411)..(411): a, c, t, g, unknown or other
  misc_feature (411)..(411): n is a, c, g, or t
  modified_base (447)..(447): a, c, t, g, unknown or other
  misc_feature (447)..(447): n is a, c, g, or t
  modified_base (715)..(715): a, c, t, g, unknown or other
  misc_feature (715)..(715): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggcctccctagtttcagactaccaccggagagtattgtgttcgacanagtcctccacgccaccctgtctttgtcctccgaagggaagcgccctaccctctccgtgaccgacgggcctagtcagtaatcggttcggccgtacctttacggaagtcgtacggtaaccaaacgaaccgtaaaccgtccggaccgacggtccctacccgaccggtaccccctanacgttcgtacggtacggtacgaccactaaccgaacggaccggactacggtcgacctaccnccgacgccgtacgtcgagcgtagtaggtaggggtanacggacgtacgtaccttcgaaccttcactacgtactacgtatcgacgcggtacgacgtaacctaggaagtacgttagtagtacgttaagtttacgttaccgtacgtaccgtaacttacgtaccgacggttacggtccgggtcccgggtacccggggtacccgtaccggttttccggacccgggtacggaaccggtaggtacggtaccgaacgttaacgaacgtagtacggtcgaccgtcgacctacgttacgtccgttattcccgttntacccg

SEQ ID NO: 262942 - DNA, 891 bp, Homo sapiens
  misc_feature: GYAE6OF01A6EQ6.8.33.C11.1.454.CMB.1.raw
  modified_base (266)..(266): a, c, t, g, unknown or other
  misc_feature (266)..(266): n is a, c, g, or t
tcagctcgcgtgtccacgaccggtgctcgatttagagtgagctcgttgggtttgggggtctgggagaggagcccagcactagaagtcggcggtgtttccattcggtgatcagcactgaacacagaggactcaccatgggagtttgggctgaacttgggttttcctcgttgcttacttttaagaggtgtccagtgtcaagtgacaacgtgggtggagtcggtaggggggaggcgtagtccaggccgtggggagtcacgagagacctntcctgtgccagcccttagtcgggttcctaccttcgaagtacgcctacggctagtcgacctacggtcgggtacccgaccgaaaacctccgagggtaccgtaaaggggtagttagggtacgggtaggggttcggtacgttaggttttcggtttacagttcggtgggacgggggtacctagggtttacggtttacctaaaggttggggttaacgttcggtaccggtttaggaacccgggtcccggttaaggggaacgggggttacccgtacgtttaacccaaccgtaacggttccctacccgaaacggtacgaaacccgttaaactaaccccgggaaagtaaacccgaaccctaaaaggtttacggtttaaacgttaccggtaaccttaaacggaaacccgtaacggttacccgttaaaccggttccgaaggggtaaccggttaaccgttaacgggggtactttaaaccgtaacccggttaacgttaacggggttaaaccggggaaacggggggtaaaccggggggaaccggtaaccggggtaaccgggggttaaccgttaacccggttaaacggtttaacccggttacccgttttagggaccccgggtttggggttaaccccggggg

SEQ ID NO: 262943 - DNA, 892 bp, Homo sapiens
  misc_feature: GYAE6OF01EEQCS.8.33.C11.1.454.CMB.1.raw
tcagctcgcgtgtccacgaccggtgctcgattttagagtgagctcgtgggagaggagtccagcactagaagtcggcggtgtttccattcggtgatcagcactgaacacagaggactcaccagtggtagtttgggctggaacttgggttttcctcgttgtcttacgttttaagaggtcgtccagtgtacaagtgacaacgtgggtggtagtcgggtagggggtacgcggtacgtaccgaggccgttggggacggtacacgagtacgtacctcctccgtgtacggcctacggtcccttcggttacgggtttcctaacccgtttacgtacggttacgaccggtaccggcgtaatccggacgtaccgtccgggttacccgaccctaaaccgttaccggacggtaacggaacggggttagttaggggtacgggttcgggggttacgggtaggtttaacggtttttcggtttactaccggtttacggacgggtccgggtagtaaggtttacggtttcgtaaggttcgttaacgttccggtacggtacgggtaccgtccgggtaagggtaaccggtaccggttaacttccgaccgttacgtaccgtacccgtaagaacggaaaccgtaaccgttaaccgaaacggtaactaaccgtaacggtttacgttagttaccggtaacctacggtaccgtaacgtaaccgttacgtacggtacggacggtaacggtaacgggtttacgtaagttaccgtaacggtacggggtaaacgggaaacggggggtaaccgggggtaaccggacgggtaggggtaaacccggttccgtaaacgttaccgttacccggttacgggttacgggtacgggtaccgggggtacccgttacgggttaaccccgggg

SEQ ID NO: 262944 - DNA, 1036 bp, Homo sapiens
  misc_feature: GYAE6OF01AMOZG.8.33.C11.1.454.CMB.1.raw
  modified_base (270)..(270): a, c, t, g, unknown or other
  misc_feature (270)..(270): n is a, c, g, or t
tcagctcgcgtgtccacgaccggtgctcgatttagagtgagctcgttgggtttgggggaggaactcgctcagttaggacccaggagggtaacctatggaacgccccagctcagcttctacttcctccgtgcctactctggcctccgtagtttcagtacttaccgtaccggagtagtactttggttagttagaccgtacgtacggttcctacccgaacgtcccctaacccgttggtttcgtttcggtaccgtaccgggaagggggtaaacnccgtacccctacccgttccgtccgtacggaccggtaaccggaccctaagttaccgaaggttaaccgttcgggttccggtacccggttaccgtttaacggaaccggttccgttaaccggtaaaccctaaacccgtaacccgtaaaccggtccggaacccgtaccggtacccgttacccgacccggtaccccgttacgtaccggttacccgttaacggttacggaccgtaaccgtaaccgtaacccggaacggttcccggggtaaccgtcgggacgtacccgtaacccgtacccgtaccggtaccggttcgggtacgacgggttacgtacggttagggttaacgggtacgtacggtaaccgtacgtttaaccgtcccgtaaccggtccgtaaccggtaccctagttacccgtaaccgttacccgacggttaccccggttagggaaccccgttacgttaaacgggtaacgtttaccgttaacggtttaaccgttaaacgtttttacgtttaacccgtttacgttaacccgtaaaccggtttaaacgttaccggttaacccggggtccgttaaccgggttaccccggggtaacccggggtttacccccgtacggtttaacccggtttacccgggacccgggtaacggtaacggggttaaccggaaggttaacccgggtaaccgtaaaccgggttaaccgtacggttacggcccgttaacgtaccgtacgtttacgtcggttacccgttgttacccggttactaccccggg

SEQ ID NO: 262945 - DNA, 838 bp, Homo sapiens
  misc_feature: GYAE6OF01C0NOH.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaccatggaagccccagctcagcttctcttcctcctgctactctggctcccagtttcagataccaccggagagattgtgttgacactagtctccagccaccctgtctttgtctccgaggggaaancgccaccctctcctgcaggggccagtacgagtaatggttcggccgccttgtaacgcgtaggtaacccaacaacctaaccgtggacccaaggtcctaccctacggcccccttagactccgtaatgggttcacgtactcccgaaaccaagggcccaaccgtcgggaccaactacccccggagtcccgaagggtttccaaggttgggacgtaagggtaggggtgtacggggtaacctagggcctttaccgacttccgtcaaaccctagtcctattaccgacgtcccgtagggtacgaccgttagaaacggtactttacgggtttacgtactttaaggtttttaaactttaccgtggttttaacccgaaaccgttactttaccccggggtaaaccggtttaaccggtccggggtttacccccgggttacccggggggtcccccttaaccgggtttttcccccggggaaccccggtttaccggggaaaccccggttaaaggggtacccggggtaacggttaaaccaacccgggtaaaaaacccggtaacccggttgggttaaccggggtacccgttacggccccttaaaacccgtcgttttaacctcggtttaacccctttcgtaaacccccg

SEQ ID NO: 262946 - DNA, 909 bp, Homo sapiens
  misc_feature: GYAE6OF01C1JNR.8.33.C11.1.454.CMB.1.raw
  modified_base (230)..(230): a, c, t, g, unknown or other
  misc_feature (230)..(230): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctccctagtttcagataccacgggagagtagttgtgttgacacgagtcctccacgtccctaccctgttctttcggtcctaccggaagggggaaaacncgtaccctaccctcctccgtagcgaacgggtcctagtaccgagtaagttcggttcggaccgtccgttacggtaacgtccgtaacggtaaccctaaccaaccgtaaaccggtcggaccgaccggtacccgtacccgaccggtacccccttacaacgttccgtaagtcggtcacgtactaccgaacgacgggtcccacgcggacctacctccgacgtaccgtaggttaccgaggtcgtaccggtagggttacgggtacggtacgggaactacggtacctttaccacttccgaacctacgttaaactaccgtactaccggacggtacccggtaacgggaccgttaccggtaaggtaaacggttacgtttaccgggttataaccgttttacgggttttaaacttccggtaaccgttaaccgttaaacgtacccgttttacggggtaaccggttaccgggttaccggggtaacccccggggtttcccggggtacccccgtttacccggggtttaccccgggttcccgggggtacccggggttaaaccgggtccgggttaaacgggtaaccgtacggttaaaacccggtaaacgggtacccggttcgggtacccggtacccgtaacggtacccctaaccgttaaccgtttgttaaccggttcccgtttacccgtttaacccccgg

SEQ ID NO: 262947 - DNA, 860 bp, Homo sapiens
  misc_feature: GYAE6OF01AN8UO.8.33.C11.1.454.CMB.1.raw
  modified_base (134)..(134): a, c, t, g, unknown or other
  misc_feature (134)..(134): n is a, c, g, or t
  modified_base (254)..(254): a, c, t, g, unknown or other
  misc_feature (254)..(254): n is a, c, g, or t
  modified_base (826)..(826): a, c, t, g, unknown or other
  misc_feature (826)..(826): n is a, c, g, or t
tcagctcgcgtgtccacgaccggtgctcgatttagagtgagctcgttggggtttgggggaggaactgctcagttaggacccagaggaaccatggaacgccccagctcagtcttcttccttcctcctgctactcnggcctccgtagtttccagactaccgaccggagagtagtttgtagttacgactaacgtcgttcctaccgacgtaccctacccgttgtttcctttcggtaccgtaccgggaaggggtaaacnccgtcccgtaacctccttaccggcgaccggaccgggtacctaagtacgaaaggttacgttccgggttccggtcccgtaccgttacggtaaccgtacggtaaccgtaaccaaaccgtaacctaaccggtcggtacccgaacggtccctacccgacccggtaccctagtaaccgttcgttacgcgggttacaccgtacgtaacccggaacgggacccgggtacctccggttaggaccctaccggtcccgaacggtacgggttacgttccggtaggtacggtaccggtaagggttagggtaacgaccggtaaccaccggtttacctacctacgtacctacgaactacgtaccgacgtccggtaaccgtcggtaacggacgtttacgaacggtaacttaggttcgttaactttagtttactttaaccgttagtaccgttaacgtaccgtacggttaccgtaacccgggtcggtaccccgggtccggtaccgttcccggtacgttcccgggacgtaaccggtgttaaacgggcgaaaccgtaccggaccgtaaacgtcgtcggtaacgccggtaacnccgtaccgttactaccgttcgtccttaccggtcc

SEQ ID NO: 262948 - DNA, 803 bp, Homo sapiens
  misc_feature: GYAE6OF01AVCBZ.8.33.C11.1.454.CMB.1.raw
  modified_base (149)..(149): a, c, t, g, unknown or other
  misc_feature (149)..(149): n is a, c, g, or t
  modified_base (169)..(169): a, c, t, g, unknown or other
  misc_feature (169)..(169): n is a, c, g, or t
  modified_base (373)..(373): a, c, t, g, unknown or other
  misc_feature (373)..(373): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacttgggttttccncgttgcttctttaagaggtntccagtgtcaagtgcaactggtggagtcgtgggggagcgtagtccaggcctggggagtcactaggagtacctccgtccgtggtgccacggccccttgttcggggttaccaccctttggacggttacgaccgttacgggcctaagtccggacctaccggtccgggtaccccaccctaaaacgtcccggaaggtccgaaaggggtntttggggacggttgggtcggtacgttacggtttgtttaccagttccggtaggtacggggtctaaggttagttacaagttgggtactcggagttcggaacggtccggtaaggaaccggtccgtaacttccgacctacgtcctaccgaacggtacgtaacccgtaaccgtacccgaaacggtaacctaacgaagtttacggtaagtttaccggaaccttacggaactacggtaaccgttaacgtccgtacggacggtaccggtaacgggtcgttaacgtacgtaccggtacgggtaacgggtaaacggggaaccgggggtaaccgtacggggtaccggggtaaccgtttacccgaaacgggtttccccttaccggtttaccgggaacccggtttacgggtaccggggtacccggttaaccggggttaccccg

SEQ ID NO: 262949 - DNA, 648 bp, Homo sapiens
  misc_feature: GYAE6OF01EQ54S.8.33.C11.1.454.CMB.1.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
  modified_base (447)..(447): a, c, t, g, unknown or other
  misc_feature (447)..(447): n is a, c, g, or t
  modified_base (629)..(629): a, c, t, g, unknown or other
  misc_feature (629)..(629): n is a, c, g, or t
  modified_base (634)..(634): a, c, t, g, unknown or other
  misc_feature (634)..(634): n is a, c, g, or t
tcagctcgcgtgtccacgaccggtgctcgatttagagtgagctcggttggggttgggggaggaactgctcagttaggacccagagggaaccatggaacgccccagctcagcttctcttcctcctgctactcctggctcccagtttcagataccgacggagacgattgtgttagacacagtctccagcccaccctgtctttgtccnccgagggaacacgcccaccctctcctgaccgcgggtcccagtcaggattgggtcgcgtccttagtaanccgtagaacctaacgacaaacctggaccacgacctccgacgccctagcttaccgtggtcgnacactaccaaggtaccgggcacgtcggactaccnccgacgtcgtacgttgacggtcgacgtaggtcggtaagacgggcgtacgtactcgcctactccgtaccgataacccgtntccggaacgtctaacgggcctacccgtaggacagttgacgtttacgtaggtttactacgttggacctacgtggttacacggtcggtccgtaccgggccggttacccgtacggttaccgcggtacgggacacgggtgaaccgtaggaaccgtacgggtaccttgggcaacctgaccctacggntaccncgttcgtactcccg

SEQ ID NO: 262950 - DNA, 870 bp, Homo sapiens
  misc_feature: GYAE6OF01A6NKK.8.33.C11.1.454.CMB.1.raw
  modified_base (233)..(233): a, c, t, g, unknown or other
  misc_feature (233)..(233): n is a, c, g, or t
  modified_base (591)..(591): a, c, t, g, unknown or other
  misc_feature (591)..(591): n is a, c, g, or t
tcagctcgcgtgtccacgaccggtgctcgatttagagtgagctcgttggggtttggggaggaactgctcagttaggacccagagggaaccagtcggaacgccccagctcagcttctcttcctcctgctactctggcctccctagttcaagaactaccgaccggagtagattgtgttagacacagtacctcacgtccctacctcgtcgtttacgtccgtaccgaacggggaacnccgacccaccctccgtccgtggaccgacgggaccacgttcgaaggtacgttggttacggtccgtacgtttacgtaagtcgtacggtaaccaacgaacctaaccggtcggaccgtacggcctacccgacggtcccctatacgtactacgtcggtacgacaacgtaccaacggaccggacctagaccggtacaccgtacccgagtacccggtaggtttaccacggggttcgaccggttagggtacggtaacggttcgggaacctacggttaccttaccgacctttaaccggtaccctaacgtaaccgttacaaccgtacgtaccggttaccgtacgggtacttaaccggtagtaaccgtntacgggttaatacgtttaacgttactaagcgtaactacgacttaaccgggcgtacgggtaccggttcccggggtacccgggttaacgtttcccggttaacccggggtaccggtaaccggggaaacccgttaacggggtacggtaaaccgttaacccggttaacccggtaaaaacggttcccggtacggggtaaaaccccgtcgggtaaaccctaccccggtttaaaccttacgggttaacccccgtttttacgttacccggtcccgttttaaaccccgg

SEQ ID NO: 262951 - DNA, 868 bp, Homo sapiens
  misc_feature: GYAE6OF01CVEIQ.8.33.C11.1.454.CMB.1.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (586)..(586): a, c, t, g, unknown or other
  misc_feature (586)..(586): n is a, c, g, or t
tcagctcgcgtgtccacgaccggtgctcgatttagagtgagctcgttgggtttgggggaggaactgctcagttaggacccagagggaaccatggaacgccccagctcagcttctcttcctcctgctactcgtgggcctaccctagttttcgaaggacttaacccgacccgggaagtaggtagttttggtgtttgaacctaacgagttccgttcccgacggacccctaacccgttcggtttcctttttaggttccctaccgggaagggggaaaaacggtccgaccccgtaaccccctccttccgtacggccgacggggccctagtaccggaagtaagttggttccggccgtaccgttcgtaaacggtccgttaacgggtaaccctaaaccgtaaacctaaaaccggttcgggacccgacggttacccctaccccggaccgggaccccccttanacttccgtaacttcgggttacncctaccttaccggaacaccgggacctagtccggactaccgtcccgtacgcgtaaggtcgaggttggcgtaggtggtgcgtaactcggtactactcgtctaacctcgtatacncttacgacgtaccgtacggactaccgtaaaggtcgtaacgttcgttacgtactttaagtttttaaccttcgtacgttaacgtaaccgttcggttaacggtacggttccgggtacccgggttaccccggttcccgggggtccctttacccggggtttcccggtacccgggtaacgggttaccgggtaaggttccggaaacgtttaccgtaaccggaaaccggtttacggcgggttcgtaccgtacgacccgtcgtacgttacgttcgtacctttcgtaacccg

SEQ ID NO: 262952 - DNA, 877 bp, Homo sapiens
  misc_feature: GYAE6OF01EKR2V.8.33.C11.1.454.CMB.1.raw
tcagctcgcgtgtccacgaccggtgctcgatttagagtgagctcggttgggtttgggggaggaactgctcagttaggacccagagggaaccatggaacgccccagctcagccttctcttcctcctgctactctggcctcccagtttcagactaccgacggagagtattgtgttgacactactctcacgccctacctgtctttgtctacgagggaacgcgaccacccgtctctgcgacggtccaagtcaagtaagttcggtacggccgttacgtttacggaacgtccgtacgtaaccaaaccgaacctaaaccgtcggaccgtacggacccgttaccgaccggtacccctctactacgtacgttaggtaccgtaccgaacgtaccggaaacggacgggccctacggtacgaccgtaacctcccggaacgtccggtaaggtcgtaacggtacggacgtaaggggtcggtaagtacgggaaactacggtctaacgccttaccgtacctaaaccctagtcctaacgtacgacggtacccggttaagggaccgttacccggtaagtaaacgttacgggtttaacggttaccgttaaaccggtttttacgtttaaacttttaacccgtacggtttaaacccgttaaaacggttaacccggtttacccgggttaaaacgggcccggggtttaacccgggtacccccgggggtttccccggggtaacccgttttacccggggttacccccgtaccgggtaaccggggtaaccggaaagggttacggtaacgttaaaccgtaacccgggaaaaacggttacggttcggggtactaaccggtacgtaaccgtacgtaccttacggtttacctcgtactttaccccgg

SEQ ID NO: 262953 - DNA, 779 bp, Homo sapiens
  misc_feature: GYAE6OF01B2TQG.8.33.C11.1.454.CMB.1.raw
  modified_base (123)..(123): a, c, t, g, unknown or other
  misc_feature (123)..(123): n is a, c, g, or t
  modified_base (130)..(130): a, c, t, g, unknown or other
  misc_feature (130)..(130): n is a, c, g, or t
  modified_base (153)..(153): a, c, t, g, unknown or other
  misc_feature (153)..(153): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
tcagctcgcgtgtccacgaccggtgctcgatttagagtgagctcgtgggagaggagcccagcactagaagtcggcggtgtttccattcggtgatcagcactgaacacgagagactcacatggngtttggntgattcggtttcctcgtgtcttntttaagaggtctctagtgtacaagtcgacaagtgggtacggagtcggtggggacggtcgttacgccgaggtccggtggggtaacgtaccgaacgaacggtacggtaaccgttcctccggttaaggtacgacggtaccgtcccgtttacggttaccgggtttaccctaaccggtttcaagggtacgtccccgtaaggcctagttcggaccgtaccggtttcccgggacccgaacccctaaaaccgtccggaaaggtacggtaacgggttaggtagggtacgggtttcgggagtaccgtttaaggttcggttttaacnggttttaacccgggnggtaacggttcgttaacggtcgttaagtacgttagtacgtcggaccgtaacggacgttaccgggaaggtaccgtaccttactaaccgaccgtacctcgacgtaacgaccgtaacaccgacgaagaacctacgtagttacgttacgtacgaacgtacgactacgacgttcggactcgggaacgttcgtaacgttcgtaatacggtaagaacgggtaggaacgggacggagtcggtacgttacccgtacgtacttacggtacgttacggtacggcgggtacggaccgttcggtcccg

SEQ ID NO: 262954 - DNA, 1020 bp, Homo sapiens
  misc_feature: GYAE6OF01C18WQ.8.33.C11.1.454.CMB.1.raw
  modified_base (299)..(299): a, c, t, g, unknown or other
  misc_feature (299)..(299): n is a, c, g, or t
tcagctcgcgtgtccacgaccggtgctcgatttagagtgagctcgtgggagaggagcccagcactagaaggtcggcggtgtttccattcggtcgatcagcactgaaacacgagaggacctcaccatggtagttgggctggaacttgggttttccctcgttgtcttcttttaagaggtgtcctagtgtacaagtcgactaacgtgggtggacggtcgggtagggggacggtcgttaacgtccgaggtcccgttagggggaggtaccgaacgaaggacgtacccttccgtccgttggtccnccgtacgttcccgttccggttagggtttaccctacccgtttacgaggtacggacccgttaccgggacctaagttccggacctaaccgggttaccggggtacccccaaaccccgtaaaaaccgtccccgggaaaaggggccggtaaaaagggggttcggttaaggggtacggggtttgggggttccggtaaccggtttaagggtttttacgtttcgaacggttcggtacggggacggggttcctttaagggtttcgttaagtaaacggtttggtacgttcgggacgttaaccgggcccgggttaccggtacggggtaaaccggtacccgtttaagtttacccggaacccttacgttaccccgttaaccggaaggtaacccgtaaacccctaaccgggttaacccgaaacgggtaaacctacgtttaaacgttacggttttaacggtacccggtaacgtaacggtaaccgtaaccggttacccgtttaaaccggtaccggttaaacggggtacggtaaaccccgggttgggtttaacccttaagtttacccgggttaacggttaaacgggtaccccgggggaaaaaggggggtcccgggtaaacgtcccgggggttaagggttaaccccgttaacggttaaacccgtttccgttttaaccggggtacgggtttacccgggtaggggaccccggggttacccggttaacggggttaacccccgg

SEQ ID NO: 262955 - DNA, 903 bp, Homo sapiens
  misc_feature: GYAE6OF01BQBV9.8.33.C11.1.454.CMB.1.raw
  modified_base (279)..(279): a, c, t, g, unknown or other
  misc_feature (279)..(279): n is a, c, g, or t
tcagctcgcgtgtccacgaccggtgctcgatttagagtgagctcgtgggagaggagcccagcactagaagtcggcggtgtttccattcggtgatcagcactgaacacagagactcaccatggagtttggctgaacgttgggttttcctcgttgcttcgttttaaggacggttcgtcctagtgtacgaagttcgactaacgtgggtggacgtcggtgggggacgcggttacgtccgacggtccgtgggtacgtacacgagtacgtaccttcgtcctggtnccgacgtccgttcgttcggttacctaccgttacgagttacgcgtacggctacgtcggcctacggtccgggtacccctaaacccgaacgtaccggaggaccggtaaaggggtagtttcggggaaggttggggtcgtctaaggttttcgttacgtacgtggtacggagggtcgtaacggttcgtacgtaaggttcgtcgtaccgtaccggtcggaaacccggtcggttaacgggaacccgggtaccgttaaccttacccgtacgtacccgttacccgtaaccggtaaccgacgtaaaacccgtaacccggtaaccggtaaacgtaacccgtaaacgttaacgtttggtttaaccgttaccgggtaaacccgtaacgtaaacccgttccggtaaaccgttacccggttaaccgtaagggtacccgggtaaacggttacgggttaacttaaccgttacgggtttaaaccgaggggttaaaaccggggaaccggggtaaaccgggggacccgtaaaggggttaccggtaaccggtttaacccggtaaaccgtttccggttaacccgggtttacgggacccggggtttaccgggcccgggttaacccgggtaacccggttacccccgggg

SEQ ID NO: 262956 - DNA, 928 bp, Homo sapiens
  misc_feature: GYAE6OF01E110Y.8.33.C11.1.454.CMB.1.raw
  modified_base (183)..(183): a, c, t, g, unknown or other
  misc_feature (183)..(183): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagttgggctgaacgttgggttttccctcgttgcttacgttttaagnggtacgtccagttgtcaagtgcaacgtgggtggagtcggtgggggagcgtagtccagccgtggggagtcacagacgtacctctccgtgtcgctacgccgttaccgttcgggttacctacccgttacgtaggtacgtccgtaacgggcaacgtcggacctacggtccgggtaccccgaaccctaaacgtccgaagggacggaaggggttacggttgggagggttcggggtacgtacgttaggtttcgttcacgttcggtacgggtaacggtcgttaagttccgtttaagtaaggttggtactcggtccgtacggaccggtaccggtacgggaccgggtacccgtaacgttacccgaccgtaccgttacccgtacggaacgtaaccgtaacccgtaaacccgttaccgtaaacggtaaacccgtaacttaaaggtttacccggttaggtttaacccggaccttaaacgggaaccgtaaccggttaaacccggttaaccgttaccggttaacgggtaaccgggttacccgtaaccggggtttaacgtaaacccgttaacccgggtttaaagggtaaacccggggttaaacgggggaaaccccggggggttaaaggggggaaacccccgggttaaggggttaaaccccgggggttaacctttaaaccccggggttaaacccggtttacccccgtttaaacccgggttttaaccccgggaaaccggttccccgggggttaaccccggggg

SEQ ID NO: 262957 - DNA, 693 bp, Homo sapiens
  misc_feature: GYAE6OF01DK1IP.8.33.C11.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (665)..(665): a, c, t, g, unknown or other
  misc_feature (665)..(665): n is a, c, g, or t
tcagctcgcgtgtccacgaccggtgctcgatttagagtgagctcgttgggtttgggggaggaactgctcagttaggacccagaggaccatggaagccccagctcagcttctcttcctcctgcctactctggctcccagtttcagactaccaccggagagtattgtgttgacacagtcctccagcccacccttgtctttgtctccgaaggggaaangcccaccctctcctgcgacggcagtcagatgtgcgtctgagctagtaccanacaacgtgcagctccgacgccctnactctagtcggtncactacagacggcacgngcactccagtaccgaggtcnggtggacgtaggtggtagngggactacgtccttaccgactttcctaccgtaacctactaccgtaactccgaacgtcccggttaagggaccgtaccgtaacggtaaggtaacgtttgggttacctacgtttaacgttttaacctttacgtacgttaaccaacgtacgttaccgtaacggtacggtaccgggtcccggttaaccccggggtccgttaacccggtttccgggtacccggtacggggtaaccgttaacgggtacggacttacgtaaaccgtaaaccgggttactgggtaccggttccgtgaacccttaacccggttacnccggtttaccgtcctttccggtaacccg

SEQ ID NO: 262958 - DNA, 843 bp, Homo sapiens
  misc_feature: GYAE6OF01A7YMO.8.33.C11.1.454.CMB.1.raw
  modified_base (219)..(219): a, c, t, g, unknown or other
  misc_feature (219)..(219): n is a, c, g, or t
tcagctcgcgtgtccacgaccggtgctcgatttagagtgagctcgttgggttggggaggaactgctcagttaggacccagagggaaccatggaacgccccagctcagcttctcttcctcctgctactctgcctcctagtttcagactaccgacggagacgtattgtgttgacactagtctaccagccctacccttgtctttcgcctaccgaggggaacncgccctacccgtctacctgacgacgggcctaggtccgaagtactgggttacgccgttccgtttacggaacgtcgtaccgtaaccgaacgtaccgaaaccgtcggtaccaccgggtcctacccgaccggtacccctactacgtaccttaggtcgtcggacctacgtaaccgacgacgggtcccacggtggaccacgtcccgacgaccgttaagggttccgacgggtcggacgttaacgggtggggttacctagggggtaacccaaggtccttacgtaccctctaaccggtaaccagttacccaagttccgaccggttaccgtacgggtaccgtacggttaacgggaaacgtttacggtttacgggttacgttacccggtttaaaggtttttaccgtaaccggtttaactacccgttaaagtacccggtttaaccgggttaacccgggtaacggttcccggggtaacccccgtttcccgggggtaacccttcccggtttacccggggacgttaacccggggaaccggtaagggttcgaaaccggttaccgaaccgggtaactaacgggttggtaccccgtataccggtaccctacgttactccggtttacgttaccctccggtaac

SEQ ID NO: 262959 - DNA, 505 bp, Homo sapiens
  misc_feature: GYAE6OF02JERMP.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccccagactcctcatctttggcgcctttaacagggccagtggaatcccagccaggttcagcggcagtgggtctaggacttcgttcactctcaccatcaatacctgcaatctgacgactttgcagtttattctgtcagcagtctgaagactggccgttcactttcgggcggagggaccaagggtgacctcaacgactgtgctgcacatctgtcttcatctccgccatc

SEQ ID NO: 262960 - DNA, 520 bp, Homo sapiens
  misc_feature: GYAE6OF02HANLZ.8.33.C11.1.454.CMB.1.raw
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctnatctatggtgcatccaacagggccactggcatcccagccaggttcagtggcagtgggtatgggacagacttcactctcaccatcatcagcctggagcctgaagatgttgctagtttattactgtcaacatcgtacgagtcggccgtccggggcctacgtttccggcccgtcggaccgaggtggagagtacgaaacgaactgtgcgtgcacatctcgtctctac

SEQ ID NO: 262961 - DNA, 517 bp, Homo sapiens
  misc_feature: GYAE6OF02JD825.8.33.C11.1.454.CMB.1.raw
  modified_base (296)..(296): a, c, t, g, unknown or other
  misc_feature (296)..(296): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctnatctatggtgcatccaacagggccactggcatcccagccaggttcagtggcagtgggtatgggacagacttcactctcaccatcatcagcctgagcctgaagatgtgctagtttattactgtcaactatcgtaccgagtcggccgtccggggcctacgtttcggcccgtcgggaccgaggtggagagtacgaaacgaactgtgctgcacatctgtctctac

SEQ ID NO: 262962 - DNA, 564 bp, Homo sapiens
  misc_feature: GYAE6OF02I5F5X.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatgggtgccatccaacgagggccactggcactcccagccaggttcagtggcaggtgggtatgggacaggacttcactctacaccatcatcagcctggacgcctagaagagtgttgctagtttattacttgtactaactataccggtaccgtaggtcggtcccgtcccgggggcctaccgtttccgggcccgtcgggaacccgtagggtcggagtacgtacgaaacggaacgtggtcggctgcaccagtctcgttcttctac

SEQ ID NO: 262963 - DNA, 545 bp, Homo sapiens
  misc_feature: GYAE6OF02IDXL1.8.33.C11.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (434)..(434): a, c, t, g, unknown or other
  misc_feature (434)..(434): n is a, c, g, or t
  modified_base (541)..(541): a, c, t, g, unknown or other
  misc_feature (541)..(541): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgtctccaggggaaanagccaccctctcctgcagggccagtcagaatgttggcgccttgaagctggtaccaaacacaaacctggccaggcctcccaggccccctnatctatggtncatccaaacngggccactggcactcccagccaggttcagtggcagtgggatgggacagacttcactctcaccatcatcacgcctggacgcctagaacgattcgtgtctagtttattactgtactaanatccgtaacgaggtcggcccgtccggggcctaccgttcggcccgtaggaccgaggtggacgagtaccgaaacgtacgtgtcggacgtgaccaccattcgtcttcctntacg

SEQ ID NO: 262964 - DNA, 538 bp, Homo sapiens
  misc_feature: GYAE6OF02GJOU9.8.33.C11.1.454.CMB.1.raw
  modified_base (296)..(296): a, c, t, g, unknown or other
  misc_feature (296)..(296): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttaccacccagttagcctggtaccaacacaaacctggccaggctcccaggtccctnatctttgatgcatccatcagggccactggcatcccagccaggttcagtggcagtgggtctgggacagacttcactctcaccatcagcagcctagagcctgaagatgttgctagtttattactgtacaacatcgtaccgagtcggccgtccggggcctacgtttccggcgtcgtacgggaccgtaggtcggagacgtacgaaacgtaacgtaggtggcgtcgacgacactcgtcgttcttacc

SEQ ID NO: 262965 - DNA, 534 bp, Homo sapiens
  misc_feature: GYAE6OF02HJCOW.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttcgtaagctggtaccaacacaaacctggccaggctccccaggcccctcatctatggtgcatccaacagggccactggcatcccagccaggttcagtggcagtgggtatgggacagacttcactctcaccatcatcagctggagctgaagatgttgctagtttattactgtcaactatcgtaccgagtacggccgtccgggggccctacgtttccggcccgtcgggaaccgtaagggtcggagagtacgaaacggaactggtggcgtgcaccatctcgtcttctac

SEQ ID NO: 262966 - DNA, 521 bp, Homo sapiens
  misc_feature: GYAE6OF02IE84B.8.33.C11.1.454.CMB.1.raw
  modified_base (206)..(206): a, c, t, g, unknown or other
  misc_feature (206)..(206): n is a, c, g, or t
  modified_base (312)..(312): a, c, t, g, unknown or other
  misc_feature (312)..(312): n is a, c, g, or t
  modified_base (516)..(516): a, c, t, g, unknown or other
  misc_feature (516)..(516): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgctccagggaaangccaccctctcctgcagggccagtcagaatgttggcgccttgtaagctggtaccaacacaaacctggccaggctcccaggccccctcatctatggtgcatccaacngggccactggcatcccagccaggtcagtgcagtggtatgggacagacttcactctcacatcatcagcctggacgcctagaagtatgttgctaagtttattactgtacaacatcgtaccgagtcggccgtccggggcctacgtttcggcccgtggaaccaggtggagtatacgaaacgactgtacggctggcacgatctgtcgtntaccg

SEQ ID NO: 262967 - DNA, 535 bp, Homo sapiens
  misc_feature: GYAE6OF02JXRZR.8.33.C11.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgtaagctggtaccaacacaaacctggccaggctcccaggccccctnatctatggtgcatccaacgngggccacgtggcatcccagccaggttcagtggcaggtgggtatgggacagtacttcactctacaccatcatcacgccgtggacgcctggaggtatgttgctagtttatactgtacaactatacgtacgtgtcggccgtccggggcctacgttccggccgtaggaccgaagtcgatatacgaacgacgtagcgtcgtgacacgactcgtcgtctctacg

SEQ ID NO: 262968 - DNA, 543 bp, Homo sapiens
  misc_feature: GYAE6OF02G4YFC.8.33.C11.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (442)..(442): a, c, t, g, unknown or other
  misc_feature (442)..(442): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgttggcgccttcgaagctggtaccaacacaaacctggccaggctcccaggcccctnatctatggtgcatccaacagggccacgtggcactcccagccaggttcagtggcaggtgggtatgggacagacttcactctcaccatcatcagcctggacgcctagaagatgttgcttagtttattacgtgtacaactatcgtaccgngtacggcccgtccgggggcctacgtttccggcccgtcgggaaccgtaaggtcggagactacgaaacgactggtggctggacactacttcgtcttcttctac

SEQ ID NO: 262969 - DNA, 605 bp, Homo sapiens
  misc_feature: GYAE6OF02JA0ZT.8.33.C11.1.454.CMB.1.raw
tcagctcgcgtgtccacgaccggtgctcgatttagagtgagctcgttgggtttgggggaggaactgctcagttaggacccagagggaaccatggagccccagctcagcttctcttcctcctgctactctggctcccagtttcagataccaccggagagattgtgttgacacagtctccagccaccctgtctttgtctccagggaagagccacctctcctgcacgggccgacgtacagaatgtgcgtcctcgtacgctacgtaccaacaacaaccgtacggacgcacggacgtcccacggccctcatcgtactggtcgcaactaccgaaccacgggccgactacggccactacccacgaccacggttcgacgtacggcgagtagggtagtacggacgacgacttcactactacaccactacactacacgaccgtcggagactagaagatagttagtactagttattactagtactaactatacgtacgtacgtacggccgtccgggtccgtaccgttacggtaccgtacggacgtacggtacggacggaacgtacgtgaaccgtaacgtacggtacggtacgtacgtacgaccgtacgtacgtacg

SEQ ID NO: 262970 - DNA, 265 bp, Homo sapiens
  misc_feature: GYAE6OF02ICP24.8.33.C11.1.454.CMB.1.raw
  modified_base (260)..(265): a, c, t, g, unknown or other
  misc_feature (260)..(265): n is a, c, g, or t
tcagctcgcgtgtccacgaccggtgctcgatttagagtgagctcgttgggtttggggaaccagcgggagttccaagtactcctttgacgtctggggccagggtaccctggtcaccgtctcctcagcctccaccaagggcccatcggtcttcccctggcgccctgctccaggagcacctccgagagcacagcggccctgggctgcctggtcaaggactacttccgacacgcgagctgagcgggctggcaaggcgcgatagnnnnnn

SEQ ID NO: 262971 - DNA, 576 bp, Homo sapiens
  misc_feature: GYAE6OF02JEBUW.8.33.C11.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
tcagctcgcgtgtccacgaccggtgctcgatttagagtgagctcgttgggtttggggaggaactgctcagttacggacccagaggggaacccatggtaagccccagctcagcttctcttcctcctgctactctggctccagtttcagataccaccggtagtagattgtgtttagacacagtctccagccaccctgtctttgctccaggggaaagngccaccctctccgtgcagggccagtcagaatgttggcgccttcgaagctggtaccaacacaaacctggccaggctccgaggccccctgatctagtgggtncatccgaacgacgggccactggacactcccagccaggttcgaggtggcaggtgggtatgggacagacttcactcncaccatcatcagcnggagctagaanatagtgactagtttattactgtacaactatacgtacgagtcggaccgtccggggacctacgtttccggcccgtacgggtaacctaagggttacggacgtacgtacgaaacgtaacgtaggtacggacgtacgacgaccgtagtacgtcgttccttcgtacg

SEQ ID NO: 262972 - DNA, 511 bp, Homo sapiens
  misc_feature: GYAE6OF02IL49E.8.33.C11.1.454.CMB.1.raw
  modified_base (391)..(391): a, c, t, g, unknown or other
  misc_feature (391)..(391): n is a, c, g, or t
  modified_base (508)..(508): a, c, t, g, unknown or other
  misc_feature (508)..(508): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgaagctggtaccaacacaaacctggccaggctcccaggcccctcatctatggtgcatccaacagggccactggcatcccagccaggttcagtggcagtgggtatgggacagacttcactctcaccatcatcagcctggancctgaagatgttgctagtttattactgtacaactatacgtaccgagtcggccgtccggggcctacgttcgcctggaccaagtgatatacaaacgaactgtgctgcactatctgtctntac

SEQ ID NO: 262973 - DNA, 520 bp, Homo sapiens
  misc_feature: GYAE6OF02HECJU.8.33.C11.1.454.CMB.1.raw
  modified_base (509)..(509): a, c, t, g, unknown or other
  misc_feature (509)..(509): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatggtgcatccaacagggccactggcatcccagccaggttcagtggcaggtgggtatgggacagacttcactctcaccatcatcagcctggagcctagaagatgtcgctagtttatactgtacaactatcgtacgagtcggccgtccggggcctacgttccggcccgtggaccgaggtggagatacgaaacgacgtgtgctgcacntctcgtctctc

SEQ ID NO: 262974 - DNA, 525 bp, Homo sapiens
  misc_feature: GYAE6OF02HLG1C.8.33.C11.1.454.CMB.1.raw
tcagctcgcgtgtccacgaccggtgctcgatttagagtgagctcgttgggtttgggggaggaactgctcagttaggacccagagggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgacaatctgacgtactttgctagtttattctgtcagcagtctgaagctggccgttcacgtttcggacggagggaccaagggtcggacctacgaaacgacgtgtggcgtgccactatctgtcttacacttccttcccgctatcg

SEQ ID NO: 262975 - DNA, 545 bp, Homo sapiens
  misc_feature: GYAE6OF02I8HGG.8.33.C11.1.454.CMB.1.raw
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcgcttcgaagctggtaccaacacaaacctggccaggctccaggcccctnatctatggtgcactccaaacacgggccactggcactcccagccaggttcagtgcagtgggatgggacagacttcactctacaccatcatcagctggacgcctgaagatgttgctagtttattactgtacaactatacgttacgaggtacggccgtccggggcctacgttccggtcccgtggtaaccgaaggtcggagtacgtacgaaacggtaactcggagtacgtagacaccgattcgtacgtcttactacg

SEQ ID NO: 262976 - DNA, 560 bp, Homo sapiens
  misc_feature: GYAE6OF02H41IS.8.33.C11.1.454.CMB.1.raw
  modified_base (555)..(555): a, c, t, g, unknown or other
  misc_feature (555)..(555): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctcccaggccccctcatctatggtgcatccaacagggccactggacactcccagccaggttcagtggcagtgggtatgggacagacttcactctcaccatacatcacgcctggacgcctagaagtagtgttcgtactagtttaactttactgtacaacataccggtaacgtaggtcggccgtaccgggggtcctaccgtttccgggcccgtcggaccgaacgggtcggagacgtacgaacgtaacgtggtcgtctagccacagtctcgttcctntaccg

SEQ ID NO: 262977 - DNA, 513 bp, Homo sapiens
  misc_feature: GYAE6OF02FQHFF.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatccagccaggttcagcggcagtgggtctaggacttcgtcactctcaccatcaataacctgacaatctgacgactttgctagtttattctgtcagcagtctgaagctggccgttcacgtttcggcggagggaccaagggtcgacctacgaacgactgtggctgcacatctgtcttcacttctcccgtcatcg

SEQ ID NO: 262978 - DNA, 543 bp, Homo sapiens
  misc_feature: GYAE6OF02IMEM5.8.33.C11.1.454.CMB.1.raw
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctcccaggcccctcatctatggtgcatccaacagggccactggcactcccagccaggttcagtggcaggtgggtatgggacagacttcactctcaccatcatcacgcctggagcctgaagatgttgctagtttattactgtacaactatcgtaccgagtcggcccgtccggggtcctacgtttccggcccgtcgggaccgaagggtggacgacgtacgaaacgtaacgtaggtggctagcacctatcgtcgtccttctac

SEQ ID NO: 262979 - DNA, 528 bp, Homo sapiens
  misc_feature: GYAE6OF02IHOR6.8.33.C11.1.454.CMB.1.raw
  modified_base (209)..(209): a, c, t, g, unknown or other
  misc_feature (209)..(209): n is a, c, g, or t
  modified_base (525)..(525): a, c, t, g, unknown or other
  misc_feature (525)..(525): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacagggccactggcatcccagccaggttcagtgcagtgggtatgggacagacttcactctcaccatcatcacgcctggacgcctgaggatgttgctagtttattacttgtacaactatacgtaccgagtacggccgtccggggcctacgttccggccgtacggaccaagtcggatacgtacgaacgactggtagcgtagcacatctcgtctntac

SEQ ID NO: 262980 - DNA, 524 bp, Homo sapiens
  misc_feature: GYAE6OF02FX0Y1.8.33.C11.1.454.CMB.1.raw
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (521)..(521): a, c, t, g, unknown or other
  misc_feature (521)..(521): n is a, c, g, or t
tcagctcgcgtgtccacgaccggtgctcgatttagagtgagctcgttggggtttgggggaggaactgctcagttaggacccagagggaaccatggaagccccagctcagcttctcttcctccttgctactctggctcccagtttcagataccaccggagagattcgtgttgacacagtctccagccaccctgtctttgctccaggggaaagngccaccgtctcctgccagggccagtcagaatgttggcgccttcgtaagctggtaccaacacaaaacctggccaggctccccaggccccctnatctatggtgcatccaanacgggccactggcatcccagccaggttcagtggcagtgggtatgggacagacttcactctcaccatcatcagcctggagcctgaagatgttgctagtttattatgtacaactatcgtaccgagtcggccgtccggggcctacgtttcggcctgggaccaagggtcgagatcgaaacgactggtggctgcacatctgtctntac

SEQ ID NO: 262981 - DNA, 540 bp, Homo sapiens
  misc_feature: GYAE6OF02F1UQQ.8.33.C11.1.454.CMB.1.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacngggccactggcatcccagcccaggttcagtggcaggtgggtatgggacaggacttcactctcaccatcatcagcctggacgctgaagtatgttgcgtagtttatacttgtactaacatcgtaccgaggtcggccgtccggggcctaccgtttccggcccgtcgggaccgagggtcggagacgtacgaaacgtactggtggcgtgacacctatctcgttctctacg

SEQ ID NO: 262982 - DNA, 537 bp, Homo sapiens
  misc_feature: GYAE6OF02H9DOJ.8.33.C11.1.454.CMB.1.raw
  modified_base (305)..(305): a, c, t, g, unknown or other
  misc_feature (305)..(305): n is a, c, g, or t
  modified_base (416)..(416): a, c, t, g, unknown or other
  misc_feature (416)..(416): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcctttgtctccgaggggaaagagccaccctctcctgcagggccagtcagaatgttggcgccttgtaagctggtaccaacacaaacctggccaggcctccaggccccctcatctanggtgcatccaacagggccactggcactcccagccaggttcaggtcggcaggtgggtaatcgggacagacttcactctcacatcatcagcctggagcctagaagagtgttgntagtttattactgtcaactatcgtacgagtcggccgtccggggcctacgtttccgccgtggaccgtagggtgagactacgaaacgacgtggacgtctgacaccgattcgtcgttctactcg

SEQ ID NO: 262983 - DNA, 548 bp, Homo sapiens
  misc_feature: GYAE6OF02JXOG0.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
  modified_base (446)..(446): a, c, t, g, unknown or other
  misc_feature (446)..(446): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttcgtaagctggtaccaacacaaacctggccaggcctccaggcccctnatctatggtgcatccaacagggccacgtggcatcccagccaggttcagtggcaggtgggtatgggacagacttcactctcacatcatcagcctggacncctaggaaacgtattgttgactagtttattactgtacaactatccgtacgngtcggccgtccggggcctacgtttccggcccgtagggaccgtaagggtcgagactacgaaacggtacgtggtcggctagccaccgattcgtcgttctctacg

SEQ ID NO: 262984 - DNA, 544 bp, Homo sapiens
  misc_feature: GYAE6OF02H9BTX.8.33.C11.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (299)..(299): a, c, t, g, unknown or other
  misc_feature (299)..(299): n is a, c, g, or t
  modified_base (541)..(541): a, c, t, g, unknown or other
  misc_feature (541)..(541): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctntcctgcagggccagtcagaatgttggcgccttcgtaagctggtaccaacacaaacctggccaggctcccaggccccctnatctatcggtgcatcccaaacagggccacgtggccatcccagccaggttcaggtggcaggtgggtatgggacaggacttcactctcaccatcatcacgcctggacgccgtagaagtatgttgtctagtttattactgtacaacatcgtaccgagtcggccgtccggggcctacgttccggcccgtgggaccgaaggtggagacgtacgaacgtaacgtggtggctgcaccatctcgttcctntac

SEQ ID NO: 262985 - DNA, 539 bp, Homo sapiens
  misc_feature: GYAE6OF02GP5TY.8.33.C11.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (378)..(378): a, c, t, g, unknown or other
  misc_feature (378)..(378): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgtgcncttganctgacanacaactgcagcnccagccctnatctatggtncatccaacngggccacgtggcatcccagcctaggttcaggtggcaggtggtatggggacagtacttcactctcacatcatcagcctggcnctgaagatgtgctagtttattactgtcaactactcgtaccgtagtcggccgtccggggtcctaccgttccggcccgtacgggaccgtaagggtcggagtacgtacgaaacggtaacgttaggacggtctacggaccaccgtactacgtcgttcttactacg

SEQ ID NO: 262986 - DNA, 550 bp, Homo sapiens
  misc_feature: GYAE6OF02HMYA2.8.33.C11.1.454.CMB.1.raw
  modified_base (317)..(317): a, c, t, g, unknown or other
  misc_feature (317)..(317): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacngggccactggcatcccagccaggttcagtggcagtgggtatgggacaggacttcactctcaccatcatcagcctggagcctgaagatgttgctagtttattactgttcaactatcgtacgagtcggccgtccgggggtcctaccgtttccggcccgttcgggaccgaagggtacggaggacgtaccgaaacgtaactggtacggcgtcgacaccactcgttcgttcttctacg

SEQ ID NO: 262987 - DNA, 562 bp, Homo sapiens
  misc_feature: GYAE6OF02IJFAX.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaatcccagccaggttcagcggcagtgggtctgggacttcgttcactctcaccatcaaataacctgacaatctgacgtactttgctagtttactttctgtcagtctagttctagaagtacgtggtccgttctacgtttcggcgggtagggaccgtaagggtcggaaccctacgaaaccgaacgtgtggcgtcgaccacccgtaatctgttcttactacttccgttaccccgtcctacttcg

SEQ ID NO: 262988 - DNA, 899 bp, Homo sapiens
  misc_feature: GYAE6OF02I1168.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngcccacccctctcctgcgacgggccagtcaagaattggttcgggccgtcctttacggtaaagtccgttacggttaacccaaaccaacccgaaaacccgtcgggacccgaacgggtccctacccccgaaccgggtcccccctacacttccttaagttcggggtcgacctaactacccgaaacggacggggacccctaacgttcgggacctaccgtacccccgaaggaccccgtaagggtttccaacggggttcgggaccgtaaggggtttacgggggttaacggttacggggggaaaccctaacgggtttaccctttaccgtaacccgtttccccgttacccgaaaccccttactttaccaacgttacccgaaccggtaccccgttacggggtaccgtacccgttaaggaaacggtacgtttacggttacggtaccgtttaaggtttttaacgtttaccgttacgttactaaaccgtacgttacccggttaaccggtaacgggttaccgggttaccccgggtacccggggggtacccctttacccgggtttcccgggtaccccggttaccggggtaacccggtaacggggttacgggtacggtaacgtaacccggaaaaccggtaaccgttcgggtacggtaccgtacggaccctaaccgtacgttccgttcggtttccttaccgtaccg

SEQ ID NO: 262989 - DNA, 549 bp, Homo sapiens
  misc_feature: GYAE6OF02GMVLN.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcacgcctggagccgtgaagatgttgctagtttattactgtacaacatcgtacgagtcggcccgtccgggggcctacgtttccggcccgtcgggaccgaagggtcggagacgtacgaaacggtaacgtggtacggtcgtagccaccgtacgtctcgttcttctaccg

SEQ ID NO: 262990 - DNA, 550 bp, Homo sapiens
  misc_feature: GYAE6OF02FOO9Q.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttaccaccagttagcctggtaccaacacaaacctggccaggctcccaggcccctcatctttgatgcatccatcagggccactggcatcccagccaggttcagtggcagtgggtctgggacagacttcactctcaccatcagcagcctagagcctagaagtatttgctagtttattactgtacaactatacgtacgagtggccgtccggggtcctacgttccggtcccgtgggaacctaaagttcgagtactacgaaacggtaacgtgtacggactcgaccaccgtactccgtacgtcttacctattcccg

SEQ ID NO: 262991 - DNA, 527 bp, Homo sapiens
  misc_feature: GYAE6OF02HAGNT.8.33.C11.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
  modified_base (522)..(522): a, c, t, g, unknown or other
  misc_feature (522)..(522): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtattgacacagtctccagccaccctgtctttgtctccaggggaaangccaccctctcctgcagggccagtcagaatgttggcgccttcgaagctggtaccaacacaaacctggccaggctcccaggcccctnatctatggtncatccaacaggggccacgtggcactcccagcccaggttcagtggcagtgggtatgggacagacttcactcncaccatcatcagcctggagccgtgaagatgttgctagtttattactgtctaacatacgtacgagtcggccgtcggggcctacgttcgccgtcggaccaggtggagactacgaaacgtacgtggtcgcgtgccacactcgtacgtctntaccg

SEQ ID NO: 262992 - DNA, 535 bp, Homo sapiens
  misc_feature: GYAE6OF02H2BF1.8.33.C11.1.454.CMB.1.raw
  modified_base (247)..(247): a, c, t, g, unknown or other
  misc_feature (247)..(247): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccgggagagattgtgttgacacagtctccagccaccctgtctttgtctccaggggaaagagccaccctctcctgcagggccagtcagaatgttggcnccttgtaagctggtaccaacacaaaacctggccaggcctcccaggccccctcatctatggtgcatccaacagggcccactggcactcccagccaggttcagtggcagtgggtatgggacagacttcactctcaccatcatcagcctggacgcctgaagatgtcgctagtttattactgtacaacatccgtacgagtgccgtccggggtccacgtttccgccgtcgggaccagggtggagactacgaaacgtactggtcggctcggcaccattcgtacgttcttcgtac

SEQ ID NO: 262993 - DNA, 607 bp, Homo sapiens
  misc_feature: GYAE6OF02JNH41.8.33.C11.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (397)..(397): a, c, t, g, unknown or other
  misc_feature (397)..(397): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccaggggaaanagccaccctntcctgcagggccagtcagaatgtgcgcttcgaagctggtaccacacaacctggccaggctccaggcccctnatctatggtncatccaacncgggaccacgtggcactcccgagccaggttcaggtggctaggtgggtatgggaacagtacttcactctcacctatcatcagcctagganccgtagaagctggttagactagtttattacgtcgtactaactataccgtaccgagttccgggcccggtaccggggtccttaccggtttccgggacccggtacggaaccggtaagggttacggacgtaacgtacccgaaaaacggtcgtttagggacggtaccgtaggaaccctaaccgtaagtccgtttacggttcccttacgtaacccg

SEQ ID NO: 262994 - DNA, 519 bp, Homo sapiens
  misc_feature: GYAE6OF02H2EC2.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (432)..(432): a, c, t, g, unknown or other
  misc_feature (432)..(432): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttgtaagctggtaccaacacaaacctggccaggctcccaggccccctnatctatggtncatccaacgcgggccactggcactcccagccaggttcagtgcagtgggtatgggacagacttcactctcaccatcatcagcctggacgcctagaagtatgttgactaagtttattactgtacaanatcgtacgagtcggccgtccggggcctacgttccgccgtggaccaagtgatatacgaacgtactgtagctgcacatctgtcttctac

SEQ ID NO: 262995 - DNA, 530 bp, Homo sapiens
  misc_feature: GYAE6OF02IBMIF.8.33.C11.1.454.CMB.1.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (527)..(527): a, c, t, g, unknown or other
  misc_feature (527)..(527): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagaatgttggcgccttcgaagctggtaccaacacaaacctggccaggctccccaggcccctcatctatggtgcatccaacngggccactggcatcccagccaggttcagtggcaggtggtatgggacagacttcactctcaccatcatcagcctgganctagaagntgttgctagtttattactgtacaactatcgtacgagtcggccgtccgggggcctacgtttccggccgtgggaaccagggtgacgatacgaaacgtaactggtcgcgtgcaccatcctgttaccttntac

SEQ ID NO: 262996 - DNA, 538 bp, Homo sapiens
  misc_feature: GYAE6OF02IL35X.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgttactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactatcaccatcatcagcctgagcctgaagatgttgctagtttattactgtacaactatcgtaccgtagtcggccgtcccgggggcctacgtttccggcccgtcgggaccgaagggtggagagtacgaacgtaacgtgtcggctgccaccgatcgtgtcttcattcccg

SEQ ID NO: 262997 - DNA, 608 bp, Homo sapiens
  misc_feature: GYAE6OF02FFGRU.8.33.C11.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccaggggaaanagccaccctntcctgcagggccagtcagatgtgcncttcgagcngtacanacaactgcagctccagccctnatcatggtncatccaacacgggccacgtggcactcccagtccaggttcagtggcaggtgggtatggggacagacttcactctacacctatcatcagcctggacgcctagaagtagtgttgacttagtttatacgtgtaccaactactacgtaacgtacgtcgggtacccgtacccgggggtccttaaccggttttcccgggaccccttagggggaacccgtaaggggttcgggtacgaacgttaccggaaaaaccggtaccgttacgggtcgggtacccgtaggacccgtaaccgtacgttaccgttacggttacccttacgttaacccg

SEQ ID NO: 262998 - DNA, 518 bp, Homo sapiens
  misc_feature: GYAE6OF02FYNMB.8.33.C11.1.454.CMB.1.raw
  modified_base (209)..(209): a, c, t, g, unknown or other
  misc_feature (209)..(209): n is a, c, g, or t
  modified_base (515)..(515): a, c, t, g, unknown or other
  misc_feature (515)..(515): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggccccctcatctatggtgcatccaacagggccactggcatccccagccaggttcagtggcaggtgggtatggggacagacttcactctcaccatcatcagcctggagcctgaagatgttgctagtttattactgtcaacatcgtacgagtcggccgtccggggcctacgtttcgcccgtgggaccaggtgacgatacgaaacgactgtgctgcaccatctgtctntac

SEQ ID NO: 262999 - DNA, 623 bp, Homo sapiens
  misc_feature: GYAE6OF02IB7U2.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtggggaggtcacgagagacctctcctgtgcagcctctgggttccaccttcagtacgctacggcatgcagtcgggtccaccaaactccgaggcaagggattgggagtgggtggctaggttgtttcatcgtggagggcaggttgttacaagtggtatgcttggacgccgtaggaacgggcgtattccaacctatcctacagacgaacaactaccgaacggaaaccaacaagttgttagtttacggaccttagaaaccgacgtaccgtaagtccgtaggaacggacgacgggtatacgtacgttacgtacggtaacggaaggggaacggggaaccgaggtacgggtacgttaccgaacgttaccgttccgttacggtaccggtcgtaccgggg

SEQ ID NO: 263000 - DNA, 615 bp, Homo sapiens
  misc_feature: GYAE6OF02I9BVP.8.33.C11.1.454.CMB.1.raw
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgngttgacacagtctccagccaccctgtctttgtctccagggaaangccaccctctcctgcagggccagtcagaatgttgcgccttcgaagctggtaccaacacaaacctggccaggctcccaggcccctnatctatggtgcatcccaacgacgggccacgtggccactccccagcctaggttcaggtggcaggtgggtangggacagacttcactctcaccatcatcacgtcctggacgccgtaggaagtagttgttcgacttaaggtttattacgttgttacctaactacgtaccggtaccgtaggtcggtcccggtcccgggggtaccctaccggtttcccgggtcccgtacgggaaccgtaacgggtacggacgtaacgtaacgtaaaccggtaacgtacggtacggacgtacggaccgtaccgtacgttcgtcgttaccttcgtaccg

SEQ ID NO: 263001 - DNA, 522 bp, Homo sapiens
  misc_feature: GYAE6OF02FNI57.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatccccagccaggttcagtggcagtgggtatgggacaggacttcactctcaccatcatcagcctggagcctgaagatgttgctagtttatacttgtcaacatcgtacgagtcggccgtccggggcctacgtttccgcccgtcgggaccgaggtcggagatacgaaacgactgtcggctgcacatctcgtctctac

SEQ ID NO: 263002 - DNA, 523 bp, Homo sapiens
  misc_feature: GYAE6OF02GXRZB.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatcctatggtgcatccaacagggccacgtggcactcccagccaggttcagtggcagtgggtatgggacagacttcactctcaccatcatcacgctggagcctagaagatgttgctagtttattactgtcaacatcgtacgagtcggccgtccggggcctacgttccggcctgggaccaggtgacgatccgaaacgacgtggtgcgtgcacgatctcgtctctac

SEQ ID NO: 263003 - DNA, 554 bp, Homo sapiens
  misc_feature: GYAE6OF02GR8VW.8.33.C11.1.454.CMB.1.raw
  modified_base (208)..(208): a, c, t, g, unknown or other
  misc_feature (208)..(208): n is a, c, g, or t
  modified_base (430)..(430): a, c, t, g, unknown or other
  misc_feature (430)..(430): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccaccctctcctgcagggccaggtcagaatgttggcgccttgtaagctggtaccaacacaaacctggccaggctcccaggccccctcatctactggtgcatccaacagggccactggcactcccagcccaggttcaagtggcagtgggtatgggacagacttcactctcaccatcatcagcctggacgctgaagtatgttgctagtttatactgtacaanatcgtacgagtcggccgtccgggggcccacgtttccggcccttcggggacctaagggtcggagagtacgaaaacggaacttggtggtcgttggaccgaccgaacgtcgtacgttccttctaccg

SEQ ID NO: 263004 - DNA, 551 bp, Homo sapiens
  misc_feature: GYAE6OF02FJ7FM.8.33.C11.1.454.CMB.1.raw
  modified_base (434)..(434): a, c, t, g, unknown or other
  misc_feature (434)..(434): n is a, c, g, or t
  modified_base (521)..(521): a, c, t, g, unknown or other
  misc_feature (521)..(521): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtattggacctgaacagcctaagtcctgaggacacgggtgtatactactgtacgaaggagggggaaccaggcgggagttccaagtactcttgacgtcgtgggccagggtaccctggtcaccgtctcctcagccctccaccaagggcccagtccgtcttccccgtggccgccctgcctccgacggacnccaccctccgacgacgccacgacgccggcccctggggcctggcccgtgggtaccaagggtaccttaccgttccgaccacgccgagcnggacggcggctggcaaggcgacatagnngn

SEQ ID NO: 263005 - DNA, 528 bp, Homo sapiens
  misc_feature: GYAE6OF02GV6BW.8.33.C11.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagaatgttggcgccttgaagctggtaccaacacaaacctggccaggctcccaggccccctnactctatggtgcatccaacacgggccactcggcactcccagccaggttcagtggcaggtgggtatgggacagacttcgactctcaccatcatcagcctggacgctagaagtatgttgctagtttattactgtacaactatcgtacgagtcggccgtccggggcctacgtttccgccgtggaccgaggtggacgacgtacgaaacgactggcgtctgcactntcgtcgtctntac

SEQ ID NO: 263006 - DNA, 539 bp, Homo sapiens
  misc_feature: GYAE6OF02GBHT0.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttcgaagctggtaccaacacaaactgccaggctcccaggcccctcatctatggtgcatcccaaacncggggccacgtggccactccccagcccaggttcaggtggcaggtgggtatgggacaggacttcactctacaccatcatcagcctggactccgtgaagtatgttgacttagtttatattcgtactaactatcgtacgtagtcggccgtccggggcctacgttcggcccgtggaccgtagggtcgagactacgaaacgactggtcgctgcaccgatcgntctntac

SEQ ID NO: 263007 - DNA, 539 bp, Homo sapiens
  misc_feature: GYAE6OF02FK67P.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacagggccactggcatcccagccaggttcagtggcagtgggtatgggacagacttcactctcaccatcatcagcctggacgcctgaagatgttgctagtttattacttgtcaactatacgtaccgtagtcggcccgtccgggggcctacgtttccggcccgttcgggaccgtaagggtggagacgtacgaaacggaactaggtcggctgcacatctgtcttctac

SEQ ID NO: 263008 - DNA, 568 bp, Homo sapiens
  misc_feature: GYAE6OF02HJG2X.8.33.C11.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (409)..(409): a, c, t, g, unknown or other
  misc_feature (409)..(409): n is a, c, g, or t
  modified_base (550)..(550): a, c, t, g, unknown or other
  misc_feature (550)..(550): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttgtaagctggtaccaacacaaacctggccaggcctcccaggccccctnatctatggtncactccaacgacgggccacgtcggcactcccagccctaggttccaggtcggcaggtgggtatgggaacagacttcactctacaccatcatcagcctggacncctagaacgtattggtgtacgttagtttaacttagtcgtaccaactagtccgtaaccggagtcgggcccgtccgggggccttacgttccggcccgtaggaaccgaggtggacgagacgaaacgacgtggcggctgccaccngttcgtacgttctatccg

SEQ ID NO: 263009 - DNA, 617 bp, Homo sapiens
  misc_feature: GYAE6OF02IJ9XZ.8.33.C11.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggtgccttgtaagctggtaccaacacaaacctggccaggctcccaggcccctnatctatggtncatccaacgacgggccacgtggcactcccagcccaggttcagtggcaggtgggtatggggacaggtactcactctacaccatcatcagtcctggacgcctagaagtatgttgacttagttttaacttacttgttacctaaactacgtacgttaccgtaggttcgggtacccggtcccgggggtcccttaccggtttcccggcccggttacgggaacccgtaagggtacggacgtacgtaaccggaaaccggtaaccgttcgggtacggtccgtacggacctaccgtacttccgttacgttccttacgtacccg

SEQ ID NO: 263010 - DNA, 660 bp, Homo sapiens
  misc_feature: GYAE6OF02IH81C.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagaatgtggcgccttgagctggtaaccaacacaaacctggaccaggcctcccaggccccctcatcctagtggtcgccactccaacgacgggccacgtggcactcccagccaggttcaggtggactaggtgggtatgggacagacttcacttctacacctatcatcacgtcctgggactccgtagaacgtagttggttacgtcgttaagttttactttacgttacgttaccaacgttacgtaccggttaaccggtagggttccgggtcccggtcccgggggtacccttaccggttttcccgggaccccggttacgggaacccgtaaggggtacggacggtacgtaacccgtaaaaccggtacgttacgggtacgggtacctacggacccgtaaccttagttcccgttacgttccttactacccg

SEQ ID NO: 263011 - DNA, 558 bp, Homo sapiens
  misc_feature: GYAE6OF02I9RT5.8.33.C11.1.454.CMB.1.raw
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcgcttcganctgtaccanacaactgccaggctccaggcccctnatctatggtgcatccaacgagggccacgtggcactcccagccaggttcagtggcaggtggtatgggacagacttcgactctccaccatcatcacgcctggacgctgaagattggttcgctagtttattacctgtaccaactactcggttaccgagttcgggtcccgtccgggggcctaccgtttcccggtcccgtacgggtaacccgtaagggtcggagtacgtaccgaaacggtaacgtggtaggcgtcgcaccgtacttctcgttcttcgtac

SEQ ID NO: 263012 - DNA, 589 bp, Homo sapiens
  misc_feature: GYAE6OF02HRDMD.8.33.C11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcnccttgaagctggtaccaacacaaacctggccaggcctccaggccccctnactctatggtcgcatccaaacgngggcccacgtcggctactcccagcccaggttcaggtcggcaggtgggtatggggacagtacttcactctcacatcatcagcctggacncctagaagtntgttcgacttagtttacttactgtacaactactaccgtacgagtcggccggtccggggtcctaccggttccggcccgtagggaacccgtaagggtcggacgtacgtaccgaaacggaccgttgggtccggtacgttaggacctaccgtagttccgttcgtaccgttactaccg

SEQ ID NO: 263013 - DNA, 525 bp, Homo sapiens
  misc_feature: GYAE6OF02G5V9Q.8.33.C11.1.454.CMB.1.raw
  modified_base (209)..(209): a, c, t, g, unknown or other
  misc_feature (209)..(209): n is a, c, g, or t
  modified_base (522)..(522): a, c, t, g, unknown or other
  misc_feature (522)..(522): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttgacgccttcgaagctggtaccaacacaaacctggccaggctcccaggccccctcatctatggtgcatccaacagggccactggcatcccagccaggttcagtggcagtgggtatgggacagacttcactctcaccatcatcagcctggacgcctagaagatgttgctagtttattacttgtacaactactcgtaccgagtcggccgtccggggcctacgttccgcccgtcggaacctaaagttgagactacgaaacgactgtgctgcacatctcgtctntac

SEQ ID NO: 263014 - DNA, 722 bp, Homo sapiens
  misc_feature: GYAE6OF02HJQ57.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtggggagtcacagagactctcctgtgcagcctcgtgggttccaccttcagtagctacggcatgcacgtcgggtcccgaccaaactccgagggcaagggattgggaggtgggtggctagtttgttcatcgtggagggctagttgttacaagttggtatgtctaggaccggtccggtaggaacggggtccgtaacgttccaaccctactaccgtacccgaaggaacgtaaccaaaccgtaccgaaacggtaaaccaacgtaaacgttacggttaacgtttacggtaacccgttacgaaaccgtaaccgtaaccgttaacgtaccgtacggaaccggtaacggtaacgggttacgttaacgtaccgttacgtaacggtaaccgggaaacgggggtaacggggggaaaccgtaaggggtacggggtaaccggttaacccggtaacggttacccgttacccggttttaacggtaccggttacggttaccggggg

SEQ ID NO: 263015 - DNA, 577 bp, Homo sapiens
  misc_feature: GYAE6OF02GPGGI.8.33.C11.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaaacctggccaggctcccaggccccctnatctatggtcgcatcccaaacgacggggcccaacgtcgggcaactccccagcccaaggttccaggtcggcaggtgggtatgggacaggacttcgactctcaccatcatcagcctggacgcctgaacgatgtgctagtttattactgtacaactatcgtacgtagtcggcccgtccggggcctacgttccgcccgtcgggaaccgtaagggtcggtacgacgtacgaaacggtaacgttgggtcgtccgttagaccacctagttccgtcgttcttctaccg

SEQ ID NO: 263016 - DNA, 562 bp, Homo sapiens
  misc_feature: GYAE6OF02JFX6O.8.33.C11.1.454.CMB.1.raw
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
tcagctcgcgtgtccacgaccggtgctcgatttagagtgagctcgttgggtttgggctgaactgggtttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgaccaaactccaggcaagggattggagtgggtgcagttgttcatcgtgaggcagtgttacaatggtatgctgacgccgtaggaacggcgattcaccatctccagacgacaactccgaaggaacanaatgtattcgactagaacngacctaagcctgagacacggtnatactcgagtacggaaggacgggaacaggcgggagtacgaagtacgtaccttgacgtcgtagggacgtacggtacctggccacgtctcctcgacgcctaccgacgacggccacgtccgtcctcccgtcggccgtcccgtgccgtccgacggacgtaccgaccgtccgacgcgaccgctaaccgg

SEQ ID NO: 263017 - DNA, 536 bp, Homo sapiens
  misc_feature: GYAE6OF02IK00H.8.33.C11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagctcgcgtgtccacgaccggtgctcgatttagagtgagctcgttgggtttgggggaggaactgctcagttaggacccagagggaaccatggaagccccagctcagcttctcttccctcctgctactctggctcccagtttcagataccaccggagagattgtgttgacacagtctccagccaccctgtctttgtctccaggggaaanagccaccctctcctgcagggccagtcagaatgttggcnccttcgaagctggtaccaacacaaacctggaccaggcctccccaggccccctcatcctatggtgcatccaacgagggccacgtggcacgtcccagccaggttcagtgcagtggtatgggacagtactcactctcacatcatcagccnggacgctagaagatgttcgactagtttatactgtacaactntacgtacgngtcggccgtccggggctacgttccgccgtcggaaccgtaggtggagactacgaacgtacgtggtcgcgtcgacactatcgtattactctac

SEQ ID NO: 263018 - DNA, 656 bp, Homo sapiens
  misc_feature: GYAE6OF02JI2T4.8.33.C11.1.454.CMB.1.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttgcgccttcgaagctggtaccaacacaaacctggccaggctcccaggcccctnatctatggtncatccaacgagggccacgtcggcactcccagcctaggttcagtcggcacggtgggtactggggaacaggtaccttcgaccttccgtacacccgtatacactccaacgtccgtagggaacgtcccgtaggaaagtagttcggttcgacgtttaagttttactttaccgtcgttaccaacgtacgttaccggttaacccgtagggttccgggtacccggttcccgggggtaccttaccggtttacccggcccggttacgggaccgtaacggggtacggagtactaccggaaaccgtaacgttcgggtacggcttacggacctaccgtacgttcgtacgttacttacctaccg

SEQ ID NO: 263019 - DNA, 574 bp, Homo sapiens
  misc_feature: GYAE6OF02IEZID.8.33.C11.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgtgcnccttcgtaagctggtaccaanacaaacctggccaggctccaggcccctnatctatggtgcatccaacagggccactggcatcccagccaggttcagtcggctaggtgggtatcgggacagacttcgaactcgtcacatcatcacgctgacgcctagaacgtatcgttgctagtttatactgtactaactagtcgaacgtagtcggtccgtccgggggtcctaccgtttcggcccggtacggaaccgtaaggtcggacgtacgtaccgaaacgtaccgttggtacggtacgtacggtacgaccctagttccgtacgttccttacgtaaccg

SEQ ID NO: 263020 - DNA, 560 bp, Homo sapiens
  misc_feature: GYAE6OF02F9NST.8.33.C11.1.454.CMB.1.raw
  modified_base (406)..(406): a, c, t, g, unknown or other
  misc_feature (406)..(406): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtagtccagcctgggaggtcacagagactctcctgtgcagcctctgggttcaccttcagtagctacggcatgcacgtcgggtcccgcccaaactcccgaggccaaggggattgggagtggggtggctaggtttgtttcatcgtggagggcagtgttacaagtggtatgcagctcgtgaagggccgatcacntctcagagacatcagaacacaatgtagttgagtctagaacacgacctaagtccgtagacgacgacggacgtacgtactacgtaggtaacggaagggaacgggggaaccgaggcgggagtaccgaacgtaccgtacgttacggagtcggtacggg

SEQ ID NO: 263021 - DNA, 557 bp, Homo sapiens
  misc_feature: GYAE6OF02H7OZI.8.33.C11.1.454.CMB.1.raw
  modified_base (208)..(208): a, c, t, g, unknown or other
  misc_feature (208)..(208): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangcccaccctctcctgcagggccagtcagatgtgcgctgagctggtaccacacaactgcagctccagccctnatctanggtgcatccaacaggccactggcactcccagccaggttcagtcggctaggtgggtatgggacaggtcttacgacctctacaccatcaatccgagcctggacgccgtagaagtatgttgctagttttattacgtgttaccaattactccgtaccgtagttccggacccgtccggggcctaccgtttccggcccgttgggaccgtagggtcgacgtataccgaaacgtactaggtcggtctaggcctaccgtgttacgtcgttccttactaccg

SEQ ID NO: 263022 - DNA, 565 bp, Homo sapiens
  misc_feature: GYAE6OF02I5AJ7.8.33.C11.1.454.CMB.1.raw
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtctgggggaggcgtagtccaggcctgggaggtcacagagactctccngtgcagcctctgggttccaccttcagtagctacggcatgcactgggtccnccaaactccaggcaagggattgggagtggggtggctaggttgttcatctggaggcagtgttcaagtggtatgctgacgccgtagacgggccgatcaccatctacagacacactccaggacacaatgtattcggacctagacagacctacgtcctgagacgacggtagtatactactgtaaccggaagggaacgggggaaccagggaccgggtagttaccgaacgtaccgttccgtttacggtacggttcggtaccgggg

SEQ ID NO: 263023 - DNA, 542 bp, Homo sapiens
  misc_feature: GYAE6OF02HKA1D.8.33.C11.1.454.CMB.1.raw
  modified_base (379)..(379): a, c, t, g, unknown or other
  misc_feature (379)..(379): n is a, c, g, or t
  modified_base (538)..(538): a, c, t, g, unknown or other
  misc_feature (538)..(538): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgaagctggtaccaacacaaacctggccaggctcccacggcccctcatctatggtgcatccaacagggccactcggcactcccagccaggttcagtcggcaggtgggtatgggacagacttcactcncaccatcatcagctggacgctagaagatgtgtctagtttattactgtacaactatcgtaacgagtcggccgtccggggcctacgttccggccgtacgggaccgtaggtacgagacgtacgaaacgtacgtgtcggcgtcgacactatctggttaccttntacg

SEQ ID NO: 263024 - DNA, 565 bp, Homo sapiens
  misc_feature: GYAE6OF02IGIK8.8.33.C11.1.454.CMB.1.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangcccaccctctcctgcagggccagtcagatgttggcgccttgaagctggtaccaacacaacctggccaggcctcccaggcccctnatctatggtncatccaacngggccacgtgcactcccagccaggttcagtcggcaggtgggtangggacagtacttcgactctcaccatcatcngcctggagctgaagatgttgcttagttacttatntacacatcgtacgngtcggccgtccggggtcctaccgtttccggcccgtacgggacccgaagggtcggaacgcgtaaccgaaacggtaccgtaggtcggtaccgtcgccgaaccgtacgttcctttacggttccttactacccg

SEQ ID NO: 263025 - DNA, 734 bp, Homo sapiens
  misc_feature: GYAE6OF02JP5H2.8.33.C11.1.454.CMB.1.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (386)..(386): a, c, t, g, unknown or other
  misc_feature (386)..(386): n is a, c, g, or t
tcagctcgcgtgtccacgaccggtgctcgatttagagtgagctcgttgggtttgggggtagggaacgtgctcagttaggaccagagggaaccatggaagcccagctcagctctcttcctcctgctactctgctccagtttcagtataccacggagagattgtgttgacacagtctccagccacctgtctttgtctccaggggtaaancgccaccctctcctgcgacggccagtcagagtcgttacccaccagttacncctggtaccaacacaaacctggccaggacctccaggcccctnactcttgatgcatccatcgacggccaacgtgccactcccgacgccgtacggttcaggtcggctacggggttcgggtcttacgggganaaccggtacctttcaaccgtttcctaccgaacctacgtcgaacggccaggtaccctaagaccgtccgtagaaaggtttactttgacgttaacggttttatacgtttcggaaactaaccggtactttacccggtaaacgtcggttccgggaccccggttacccggggtcccggtttaactttaccccggggtacccgttaacggggtaaaaccccttaaaagtttaccggaacggtactttaacccggaaaaacccgttaacgggttaccggttacgggtcccgtaccgttaccaaacccggttctttacccggttacgtttaacccgtttcctaacccggtttacccc

SEQ ID NO: 263026 - DNA, 527 bp, Homo sapiens
  misc_feature: GYAE6OF02GR4TQ.8.33.C11.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgaagctggtaccaacacaaacctggccaggctcccaggcccctnatctatggngcatccaacagggccactggcatcccagccaggttcagtgcagtgggtatgggacagacttcactcncacatcatcacgcctggacgcctagaagatgtgactagtttatacgtgtacaactatcgtacgagtcggcccgtccggggtcctacgttccggcccgtcggaccgtagggtgacgatacgaaacgtacgttgcggtctgacactatctgttctctc

SEQ ID NO: 263027 - DNA, 590 bp, Homo sapiens
  misc_feature: GYAE6OF02HQE04.8.33.C11.1.454.CMB.1.raw
  modified_base (328)..(328): a, c, t, g, unknown or other
  misc_feature (328)..(328): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacagagactctcctgtgcagcctcgtgggttccaccttcagtagctacggcatgcacgtgggtcccaccaaactccaggcaagggnttgggagtgggtgctagtttgttcatcgtggaggctagttgtacaagtggtatgctgacgcgtaggaacggcgtatcacctatctaccagacgacaactcgaaggaacacaatgttattcggacctagaacacgtacctaacgtccgtagaacggacgtacggtagtactactacgtaggtaacggaacgggaacggggaaccgacgggacgggtacgtaccgtaacggtaccgttacgttacggtaccggtcgtaccgggg

SEQ ID NO: 263028 - DNA, 550 bp, Homo sapiens
  misc_feature: GYAE6OF02HY501.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaaacacaaaacctggccaggctcccaggcccctcatctatggtgcatccaacagggccacgtggcatcccagccaggtcagtggcagtgggtatgggacagacttcactctcacatcatcagcctggagctagaagtatgttgactagtttaattacttgtactaactatacgtacgtacgtcggccgtccggggccgtacgttccggtccgtcggagacccccggtggacgagtacgaaacgtaacgtggtcgtacgtcgcaccgtatactcgttcttctaccg

SEQ ID NO: 263029 - DNA, 631 bp, Homo sapiens
  misc_feature: GYAE6OF02GBBY9.8.33.C11.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (414)..(414): a, c, t, g, unknown or other
  misc_feature (414)..(414): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcagggccagtcagaatgttggcncttcgaagctgtacanacaacngcagctccagccctnactctatggtcgcactccaacgacgggccacgtcggacactccccgagcccgtaggttcaggtcggacgtaggtgggtagcgggacacggtacttcactcctacacctatcactcacgccgtgggacnccgtggaggtattaggtcgtacgttagtttaacttactacgttacaaactacgttaccggtaaccgtgggtaccggtcccgggtacccggggtaccttaccgggtttcccgggacccgtacgggaaccgtaacggtcgtacgttaacgtaaccgtaaacggtacgttcgggacggtctagaccctacgtacgttccttcggttaccttacttacccg

SEQ ID NO: 263030 - DNA, 588 bp, Homo sapiens
  misc_feature: GYAE6OF02JUVWH.8.33.C11.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaanagccaccctctcctgcagggccagtcagaatgttggcnccttgaagctggtaccaacacaaacctggccaggcctccaggcccctnatctatcggtgccatcccaacgacgggccaagtggccatcccagccaggttcagtgcaggtgggtancgggacagacttcncgttccncaccgatcactcagccgtggacgacctagaacgacgttgtgtacgttagttactttacgttacgtacaactcgtacggttaccgaggttcggacccggtccggggtacctaccgtttcggcccgtacggaaccgtagggtacggtacgacgttacgaaacggtacgtaggtacgtctacggaccacgtactactcgttcgtactcg

SEQ ID NO: 263031 - DNA, 659 bp, Homo sapiens
  misc_feature: GYAE6OF02I2S2G.8.33.C11.1.454.CMB.1.raw
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatggttggcnccttgaagctggtaccaacacaaacctggccaggctcccaggccccctnatctatggtncatccaacgacgggccacgtcggcacgtccccagccgtaggttcaggtggaccgtagggtggggtatcggggactaggtaccttacacttctccaacctatcatccgacgtccgtaggtaccgccgtagaaagtagttggttacgacgtttaagtttaactttacgtacgttacctaactacgttaccggttaacccgtagggtccggtacccggtccgggggtacccttaccggtttcccgggtacccggtacgggaaaccgttaggggtacggtacgacgttaccgaaaaccggtacggtacggtcggtacgtcgtacccaccgtacttccgtacgttaccgttctacccg

SEQ ID NO: 263032 - DNA, 550 bp, Homo sapiens
  misc_feature: GYAE6OF02GCPDR.8.33.C11.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (398)..(398): a, c, t, g, unknown or other
  misc_feature (398)..(398): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctntcctgcagggccagtcagaatgttggcnccttcgtaagctggtaccaacacaaacctggccaggctcccaggcccctnatctatggtgcatccaacgacgggaccacgtggccactcccagccaggttcaggtggcaggtgggtatggggacaggacttcactctcaccatcatcagcngacgctgaagatgtgtctagtttatactgtactaacatacgtacgtagtcggccgtccggggtcctaccgtttccggcccgtcgggaccgtagggtaggaggtactaccggaaacgacgtacggtggctcgcaccgatctcgttctctaccg

SEQ ID NO: 263033 - DNA, 537 bp, Homo sapiens
  misc_feature: GYAE6OF02FVWV5.8.33.C11.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagaatgttggcgccttgtaagctggtaccaacacaaacctggccaggcctcccaggccccctnatctatggtgcatccaacagggccatggcactcccagccaggttcaggtggcagtgggtatgggacaggacttcactctacaccatcatcacgcctggacgcctagaacgatgttgctagtttattacttgtcaactatcgtacgagtcggcccgtccgggggcctacgtttccggcctcgggaccgtaggtcggagactacgaaacgtactagtggactgcaccatctcgttcttctac

SEQ ID NO: 263034 - DNA, 648 bp, Homo sapiens
  misc_feature: GYAE6OF02J16GU.8.33.C11.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
tcagctcgcgtgtccacgaccggtgctcgatttagagtgagctcgttgggtttggggaggaacgtgctcagttaggacccagagggaaccatggaagccccagctcagcttctcttcctcctgctactctggctcccagtttcagataccaccggagagattgtgttgacacagtctccagccacctgtctttgctccagggaanacgccacctctcctgcagggccagtcagaatgttggcgccttcggaagctggtaccaacacaaacctggaccaggcctcccaggcccctnatctatggtgacataccaacgtacgggccacgtgcactcccagccaggttcagtcggcaggtgggtacgtgggacagtaccttcaaccgttctaccgaacctatccgtaactaccgtacgtaccgttacgggacgtacccgtagaaacgtacgttgttacgtacgtagtttacttacgttacgtactaactagtaccggtaacgtacggtacggtacccgtacccgggggtaccttaccggtttccggccccgttacgggaaccgtaacgggtacggtagtacgttaccggaaaccggtacgtacggtacggtacgtacgtcgaaccgtacttacgtacgttccttacgtacg

SEQ ID NO: 263035 - DNA, 546 bp, Homo sapiens
  misc_feature: GYAE6OF02FQ400.8.33.C11.1.454.CMB.1.raw
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctnatctatggtgcatccaacagggccactggcactcccagccaggttcagtggcaggtgggtatgggacagacttcactctcaccatcatcagcctggacgcctagaagtatgttgcttagtttattacttgtaccaactatacgtacgtaggtcggccgtccgggggcctacgtttccggccgtcggaccgtaggtggagacgtacgaaacgactcggtagcgtagacacctactcgtcgtcttctaccg

SEQ ID NO: 263036 - DNA, 581 bp, Homo sapiens
  misc_feature: GYAE6OF02FND6Z.8.33.C11.1.454.CMB.1.raw
tcagctcgcgtgtccacgaccggtgctcgatttagagtgagctcgtgggagaggagcccagcactaagaagtcggcggtgtttccattcggtgatcagcactcgaacacagaggactcaccatggagtttgggctgaactgggttttcctcgttgcttcttttaagaggtgtccagtgtcaagtgcaactggtggagtcgtgggggagcgtagtccagcctgggagtcacagagactctcctgtgcagcctcgtgggttcaccttcagtagctacggcatgcacgtgggtcccgccaaactccgaggcaagggattggagtgggtggcagttgttcatctggaggcagtgttcaagtggtatgctgacgtcgtggacggccagttcacatctcagagacaactccaaggaaccacaattagtacgttaggacctagaacacgacctaagtcctggacgacgacgggttatactactacgtacgtaaggacgggacgggggaccgacgggcgggtaacgttaccgaacgttaccgttacgtttacggaccgttccggtcggggtaccgtacgggttacccgg

SEQ ID NO: 263037 - DNA, 635 bp, Homo sapiens
  misc_feature: GYAE6OF02HPO6M.8.33.C11.1.454.CMB.1.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
  modified_base (475)..(475): a, c, t, g, unknown or other
  misc_feature (475)..(475): n is a, c, g, or t
tcagctcgcgtgtccacgaccggtgctcgatttagagtgagctcgttgggtttgggggaggaactgctcagttaggacccagagggaaccatggaagcccagctcagcttctcttcctcctgctactctggctcccagtttcagataccaccggagagattgtgttgacacagtctccagccaccctgtctttgtctccaaggggaaagacgcctaccctctcctgcagggccagtcagaatgttgcgccttgaagctaggtaccaacacaaacctggccaggcctcccaggcccctnatctatggtncatccaaagcgggcccacgtggacaactccccagccctaagggttcaggtgactaagggtgggtancggggaacaggtactttcgacttccacaaccctatacagtcgaacgtcgttagggaactccgtagaaagtatggttcgacttagtttaattactgaccaanagtacgtacgtgtacggccgtccggggaccttacgtttccgcccgtagggaacccgtaaggggtacggacggtaacttaaccggaaacgtaacggtcggttacgggtacctacgggtaccctaaccgtaacgtttaccgtcgtttaccgttattaacccg

SEQ ID NO: 263038 - DNA, 553 bp, Homo sapiens
  misc_feature: GYAE6OF02FK7HI.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttgacgccttcgtaagctggtaccaacacaaacctggccaggctccccaggccccctcatctatggtgcatccaacagggccactggcatcccagccaggttcagtggcagtggtatgggacagactcactctcaccatcatcagcctggagcctgaagatgttgctagtttatacttgtactaacatcgtacgtagtcggtccgtcccgggggcctacgtttccggcccgtagggacctaagggtcggtagacgtacgtaaaaccggacgtacggtcggacgtgaccaccgtacttcgtacgttcttctacc

SEQ ID NO: 263039 - DNA, 610 bp, Homo sapiens
  misc_feature: GYAE6OF02I8Q50.8.33.C11.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtcttgtctccagggaaangccacctctcctgcaggccagtcagatgtgcncttganctgtacanacaactgcagctccagccctnatctatggtgcactccaacgaggccactggcatccagccaggtcagtgcaggtcggtatcgggacacgcttacgactcgtcaccgattaccatcaagccctagggaacgtcctagtaacgaattcgttacggaccttaaggttttacttaccgtagttaccaaaccgttactacccggttacgaacggttccggtacccgttaccgggggcctaaccggttttcgggccccgttagggaaccctaagggttcggagtacgttaccgaaacggtaactcggtacggtccgttacggactaacccggtcgttaccggttcgttaccgttacgttaaccgg

SEQ ID NO: 263040 - DNA, 609 bp, Homo sapiens
  misc_feature: GYAE6OF02HRGOH.8.33.C11.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (399)..(399): a, c, t, g, unknown or other
  misc_feature (399)..(399): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgctccaggggaaangccaccctctcctgcagggccagtcagaatgtggcncttgaagctggtaccaacacaaactggcaggctccgacggcccctnatctatggtgcactccaacncgggccacgtggcactcccagccagttcagtggcaggtggtatgggacagacttcactctcacagtcatcacgctggacgctagaacgtnttcgttgcttaagtttaacttactcgtacaaactagtacgtaccggtaggtcggtacccggtcccgggggtacccttaacggtttcccgggacccgttagggaacccgtaacgggtcgggacgtaacgtaccgaaacggtaacgttcggtacgggtccgtaaacggtccgaacccgtacgttccgtttacggttccctttacgttaaccg

SEQ ID NO: 263041 - DNA, 537 bp, Homo sapiens
  misc_feature: GYAE6OF02GFUIK.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacacgggccacgtggcactcccagccaggttcagtggcaggtgggtatgggacagacttcactctcaccatcatcagcctggacgcctagaagatgttgactagtttattactgtacaactatacgtacgagtcggccgtccggggtcctacgtttccggcccgtcgggaccgagggtcgacgactacgaacgtacgtggtggctgacacgatctgtctctac

SEQ ID NO: 263042 - DNA, 773 bp, Homo sapiens
  misc_feature: GYAE6OF02ID7ZT.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagatttgtgttgacacagtctccagccaccctgtctttgctccaggggaaangccaccctctcctgcagggccagtcagaatgttggctcttgaagctggtacaacacaaacctgcctaggcctccacggccccctgattcctatggtcgcgacttaccaaacgacgggcccacgtcggactaactccccgaagccgtaaggtttccaggtacggctaacggttgggggtacgttgggacgtaagtaccgttcgaaccttcctaccaacccgtattcccaattccacgtccgtacgggtacgacccgttgaaacggtagttaggttacggtacttaagttttaacttaacggttgtaaccctaacgtaacgttaccggttaaccggtaagggttccggggtaccccggttccccggggggtacccgttaacccggtttttcccggggtcccccggttaaccggggtaacccgttaaacgggggttcgggtaaacggtaacggtttaaccggtaaaacccgggtaaccggttaccgggttaccgggaaccgttaccggtaaccgtaacccggttaacgtttcccggtttaaccggtttccgtttacccgttacccgg

SEQ ID NO: 263043 - DNA, 553 bp, Homo sapiens
  misc_feature: GYAE6OF02GCIDN.8.33.C11.1.454.CMB.1.raw
  modified_base (209)..(209): a, c, t, g, unknown or other
  misc_feature (209)..(209): n is a, c, g, or t
  modified_base (319)..(319): a, c, t, g, unknown or other
  misc_feature (319)..(319): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttcgaagctggtaccaacacaaacctggccaggctccccacggccccctcactctatggtgcatccaacgngggccacgtggcatcccagccaggttcagtggcaggtgggtatgggacagacttcactctcaccatcatcagcgngacgctgaagntgtcgctagtttattactgtacactatccgtacgtagtcggtcccgtccggggtcctaccgtttccggccgtcgggaccgtagggcggtagactacgaaacggacgttggtcggtacgtcgacaccgtacttcgtcgttcttctaccg

SEQ ID NO: 263044 - DNA, 561 bp, Homo sapiens
  misc_feature: GYAE6OF02GBOR5.8.33.C11.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaangccacctctcctgcagggccagtcagaatgttgcnccttcgaagctggtaccaacacaacctggccaggctcccaggcccctnactctatggtgcatccaacgacggggccacgtggccactccccgagccaggttcaggtggacagggtgggtatggggacaggtaccttcacttcncaccatcatcgacgtcctggacnccgtagaagtgtgttgacttaagtttatactgtacaactactaccgtacgaggtcggtccgtccggggacctacgtttccggccgtacgggacctagggtcgagtacgtaccgaacgtaactggtcggactagcactagtcgtgtctctacg

SEQ ID NO: 263045 - DNA, 543 bp, Homo sapiens
  misc_feature: GYAE6OF02IKC3X.8.33.C11.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
tcagctcgcgtgtccacgaccggtgctcgatttagagtgagctcgttgggtttgggggaggaactgctttcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaaacctggccaggctccaggcccctnatctangtncatccaanacgggccactggcatcccagccaggttcagtggcagtggangggacaggacttcacttctcaccatcatcagctggancctgaagactgttgactagtttaattactgtacaacatacgtaccgagtcggaccgtccggggcctacgttccggccctacgggacctaaggtggagactacgaaacgtaacctggtacggtctaggcaccgtactactcgttacttctac

SEQ ID NO: 263046 - DNA, 563 bp, Homo sapiens
  misc_feature: GYAE6OF02HR4T7.8.33.C11.1.454.CMB.1.raw
  modified_base (394)..(394): a, c, t, g, unknown or other
  misc_feature (394)..(394): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgccacccgtctcctgcagggccagtcagatgttgcgcttcgaagctgtaccaacacaaacctggccaggcctccaggcccctcatcctatggtgcacgtccaacgagggccacgtcggcactcccagccaggttcagtggacaggtgggtatgggacagtactcactctacaccatccatacncgctgacgcgtagaagatgtcgtactagtttattactgtacaactataccgtacgtagtcggtccgtccggggacctacgttccgccggtcggaccgtagggtcgacgacgtacggaaacgacgtaggtcgtcgtacgactacctacgttctacggttccttacgtacg

SEQ ID NO: 263047 - DNA, 548 bp, Homo sapiens
  misc_feature: GYAE6OF02GZE90.8.33.C11.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (544)..(544): a, c, t, g, unknown or other
  misc_feature (544)..(544): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaaacctggccaggctccccaggccccctnactctatggtgcatccaacagggccacgtggcatcccagccaggttcagtggcaggtggtatgggacagacttcactctcaccatcatcacgtcctggacgctgaaagtatgttgctagttttatacttgtacaactatccgtacgagtcggcccgtccggggcctaccgtttccgggcccgtggacctaagggtggacgacgtacgaaacgtactaggtcggctgaccaccgtatccgtgtcctntacg

SEQ ID NO: 263048 - DNA, 737 bp, Homo sapiens
  misc_feature: GYAE6OF02GFUYL.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagaatgttgcgccttcgtaagctggtaccaacgacaaaccgtcgccaggcctccccaggccccctcactctagtcggtgctactccaaacgacgggaccacgtggccacgtccccagcccgtagggttcaggtcggcgaggtgggtaatggggaacacggtacttcaactcctaccaacctatccatcaaggtcccgtgggacgtccctaggaacgtagtttcggttcgacctttaacggttttacttaacggttcgttaacctaaaccgtacgtttaccggtaaccgggtacggttacccggggtccccgggttacccggggggtaccccttaacccgggttttcccggggacccccgttacggggtaacccgtaaggggttaccgggaacgttaaccgttaaccggaaaaacccgggttacgttacggggttacggtaccgttacgacccgtaacccgttaacgttcccggttaccggttttacccttccggttaacccg

SEQ ID NO: 263049 - DNA, 705 bp, Homo sapiens
  misc_feature: GYAE6OF02GXI66.8.33.C11.1.454.CMB.1.raw
  modified_base (358)..(358): a, c, t, g, unknown or other
  misc_feature (358)..(358): n is a, c, g, or t
tcagctcgcgtgtccacgaccggtgctcgatttagagtgagctcgttgggtttgggggaggaactgctcagttaggacccagagggaaccatggaagcccagctcagcttctcttcctcctgctactctggctcccagtttcagataccaccggagagattgtgttgacacagtctccagcccaccctgtctttgtctccaggggaagagccaccctctcctgcgagggccagtcagaatgttggccgccttcgtaagctacggtaccaaacaccaaacctggaccaggcctccccgacggccccctcatcctagtggtcgaccacgtacccaacggacgggccacgtcggacctacnccccgagcccgtagggttccaggtcggacgtagggttgggtagtaggggaccagtaccgttactaaccttccaccaaccctatccgaaattccgaacggtcccgtagggtaaccgcccgttaggaaagttacgttggtttacgactttaagtttttacgttacccgtagttaaccgaaacttacgtacccggttacggacgggttaccgggcccgggtacccggggttccctaaccggtttccgggccccggttaggggaacccgtaggggtacgtacgacgttaacccggaaaccgtaaggttcggtaggacctggacccatcgttactttcggtccttactcccg

SEQ ID NO: 263050 - DNA, 540 bp, Homo sapiens
  misc_feature: GYAE6OF02IIZ2H.8.33.C11.1.454.CMB.1.raw
  modified_base (317)..(317): a, c, t, g, unknown or other
  misc_feature (317)..(317): n is a, c, g, or t
  modified_base (386)..(386): a, c, t, g, unknown or other
  misc_feature (386)..(386): n is a, c, g, or t
  modified_base (447)..(447): a, c, t, g, unknown or other
  misc_feature (447)..(447): n is a, c, g, or t
  modified_base (535)..(535): a, c, t, g, unknown or other
  misc_feature (535)..(535): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcagggccagtcagaatgttggcgccttcgaagctggtaccaacacaaacctggccaggcctcccacggccccctcactctatggtgcatcccaanacggggccacgtcggcactcccagccaggttcaggtgcgaggtgggtagtgggacaggacttcacttcncaccatcatcagcctggacgcctagaagattcggttgctattttagttactgtacaactanaccgtacgagtcggcgtccggggctaccgttccgcctggaccaggtgagtacgacgaacgagtcgtagctagcacgtctcgtctcctntaccg

SEQ ID NO: 263051 - DNA, 538 bp, Homo sapiens
  misc_feature: GYAE6OF02HN3B6.8.33.C11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
  modified_base (535)..(535): a, c, t, g, unknown or other
  misc_feature (535)..(535): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcnccttgaagctggtaccaacacaaacctggccaggctcccagcccctnatctatggtgcatccaanagggccacgtggcatcccagccaggttcagtggcagtgggtatgggacagacttcactcncaccatcatcacgctggagcctagaagatgttgctagtttattactgtacaacatcgtacgagtcggccgtccggggcctacgtttccggcccgtcgggaccgtaaggtcggagaacgtacgaaacgtaacgtggtcggtctcgcacctacttctacgttcttntac

SEQ ID NO: 263052 - DNA, 759 bp, Homo sapiens
  misc_feature: GYAE6OF02IHP9V.8.33.C11.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
tcagctcgcgtgtccacgaccggtgctcgatttagagtgagctcgttgggtttggggaggaactgctcagttaggacccagagggaccatggaagccccagctcagcttctcttcctcctgctactctggctcccagtttcagataccaccggagagattgtgttgacacagtctccagccacctgtctttgtctccgagggaaanagccacctctcctgcagggccagtcagaatgtggcnccttgtaagctaggtaccaacacaaacctggccaggcctccaggcccctcatctatggtgacactccgaaacncggggaccacgtcggacactaccccgagacccgtaggttaccgaggtcggacgtagggtaggggtaacgtcgggggaacaacggtaccgtttaccaaccttccgttacccaaccctatttaccgaacttaccgaacggtcccgttagggaaccgtacccgtaggtaaaacgtaagtttcgggtttacgacgtttaaacggtttttaactttaaccgtaggttaacctaaacgtacgttacccggttaacggtacggttacgggtccccggtacccgggggtacccttaccggttttacccgggacccgttacggggtaacccgtaacggggttacgggacgtaacggttaacccgaaaaccggttaacggtacgggtacggtaccgtaccggtacccgtaaccgttaaccgttacccgttacggttcccgtttaccgtaacccg

SEQ ID NO: 263053 - DNA, 584 bp, Homo sapiens
  misc_feature: GYAE6OF02HPKQD.8.33.C11.1.454.CMB.1.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (560)..(560): a, c, t, g, unknown or other
  misc_feature (560)..(560): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcgccttgaagctgtaccaacacaaacctggccaggctccgacggcccctcactctatggtgctatccaaacgngggaccacgtcggacactcccacgcccagggtttccaaggtcggcacggtaggggtagtggggacagacttcactcctcaccagtcatcgacgtccgtggacgtccgtaggaaacgtagttggttgactagttttagttactgttacaactatacgtacgagtcggccgtccggggcctacgttccgaccggtcggaccgagggtaggagagtaccgaaacgacgtaggtggccgtcgacnccgtacttcgtcgttcgtctaccg

SEQ ID NO: 263054 - DNA, 650 bp, Homo sapiens
  misc_feature: GYAE6OF02G4G36.8.33.C11.1.454.CMB.1.raw
  modified_base (623)..(623): a, c, t, g, unknown or other
  misc_feature (623)..(623): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcgacgggccagtcagaagtgttggcgtccttacgtaagctggtaaccaacaacaaacctcggaccacggcctccccgacggcccctcactcctagtggtcgcactaccgaacgcgggaccacgtcggcactcccagccacggttcacggtggacgtaggtgggtagtacgggacgacgtacttcaccgtctaccaccactactactcgacgtccgtagggactaccgtagaacgtagttcgttcgtacttagtttactttactgttaccaattacgtaccgtaccggtagttcccgggcccggtacggggtacccttaccggtttcccgggacccgtacgggaaccgtaagggtcggagtactaaccggaaacggtcgttgggtacggactcgacnccgtagtccttggttaccttagtaccc

SEQ ID NO: 263055 - DNA, 700 bp, Homo sapiens
  misc_feature: GYAE6OF02JFAFI.8.33.C11.1.454.CMB.1.raw
  modified_base (362)..(362): a, c, t, g, unknown or other
  misc_feature (362)..(362): n is a, c, g, or t
  modified_base (696)..(696): a, c, t, g, unknown or other
  misc_feature (696)..(696): n is a, c, g, or t
tcagctcgcgtgtccacgaccggtgctcgatttagagtgagctcgttggggtttggggaggtcacagagactctcctgtgcagcctctcgggttcaccttcagtagctacggcatgcactgggtccgccaaactccaggcaagggattggagtgggtggcagttgttcatctgagggcagtgttcaatggtatgcgtgacgccgtgaacgggccattcaccgatctccagagacaactccgaggaacacaatgtattggacctgaacagacctaacgtcctgacgacacggtgtatactactggtacggaaggacggggggaacacggcgggagttccgaaagtacctcctttgacgttcgnggggccgagggtaccctgggtccaccggtctcctcgacgcccttcccaaccgaacgggccctacgtccggttcccttacccccgtcggccgtccccgtgcccgttaccgacgggtaccgtacccgacccgttaccggaacgtacgcccgtaacccgacggtaccccgggtccccggttacggggaccgttcccgggacccggttcggggttacccgaaaccgggttacccgttacccgtttaccccggaacgacccggtacgacggtaccgtacgggaacggccggggtacgtccgggacgtaaccgggccgtaccgaacggtacgcgtacgtnaccg

SEQ ID NO: 263056 - DNA, 748 bp, Homo sapiens
  misc_feature: GYAE6OF02HUBT7.8.33.C11.1.454.CMB.1.raw
  modified_base (721)..(721): a, c, t, g, unknown or other
  misc_feature (721)..(721): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccgaggggaagcgcccaccctctcgtgcgacggaccagtacaagtagttggttcggccgttccgttagtaacgtcgtacggtaaccaaaccaactaaaccgtcggaccgacgcctaccccgaccggtcccctatacttcgttagacgtcgactactcctagtccgaacggccacgtcgacctccaccgacgtaccgtaggttaccgaggtcgacgtacgggttcgggtccggtacgggaactacggttacttacctaccgttacccaacgtaaccctacgtaccacgaccgacgtacccgttaaggacccgttaccgtaaagggttaactttcggttttagaaccgttttaagttttaactaccgtacgttaaccaaccgttcgttaacccggttcggaagggtcccgggttacccggggtcccgggttacctttccggttacccggaccggttaacgaaaaccttaggtcgaacttacgtaaaccgtaacgtacgttcgggacgtacgtcgaaccgtaccgttntaccggtttacgttaccttactacccg

SEQ ID NO: 263057 - DNA, 600 bp, Homo sapiens
  misc_feature: GYAE6OF02GNAVM.8.33.C11.1.454.CMB.1.raw
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (417)..(417): a, c, t, g, unknown or other
  misc_feature (417)..(417): n is a, c, g, or t
  modified_base (594)..(594): a, c, t, g, unknown or other
  misc_feature (594)..(594): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaacctgcaggctccaggcccctnactctatggtcgcatccaacgagggccacgtggcactcccagcctaggttcagtggactagggtggtagtgggactacggacttcacttctcaccatcactcacgcgtggacgtccgtagaagtnttggttgacttagttttaacttacgtacgtactaactagttaccgtaacggtcggtcgggtcccggtccgggggccttaccggtttccggcccgtacgggaaccgtagggtacgtacgtaacgtaaccgtaaacggtacgtggtacggccgtgacccgactcgttcgtcgttccttntacccg

SEQ ID NO: 263058 - DNA, 663 bp, Homo sapiens
  misc_feature: GYAE6OF02G68RX.8.33.C11.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagaatgttggcgccttcgaagctcggtaccaacaccaaacctggaccaggcctcccaggccccctnatctatggtgcatccaacgacgggccaacgtcggcactccccagccaggttcagtggacaggtgggtatggggacaggacttcactctccacgtatcactcgacgtcctgggacgtccgtaggaaagtacttggttacgacttagttttaacgttacgttacgtacaaacgtcttaccgggtaccgtaaggttcccgggtacccgggttcccgggggtaccttaccggttttacccgggccccggttacggggaaacccgtaaggggttacggaacggtacttaacccggaaacggtaccgtttaggcgggtaccttacggaccttaaccgagttaccgtacggtttacttaccttaacccgg

SEQ ID NO: 263059 - DNA, 739 bp, Homo sapiens
  misc_feature: GYAE6OF02IAUKA.8.33.C11.1.454.CMB.1.raw
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccactggagagatcgtgttgacacagtctccagccaccctgtctttgtctccaggggaaagngccaccctctcctgcaggccagtcagatgtgcgcttcgagctggtacaacacaaacctggccaggctcccaggcccctnactctagtggtcgcactccaacgngggccacgtggcactcccagccgtaggttccgagttcggctaaggtggggtagtacgggacaaggtaccgttctaacctcctacaccctaattccaatccgaacggtccgtagggacgtccgtaggaagtaacgttgggttacgtaacgttaaggtttttaacgttaacgttacggtaccgtaaaaccgttaacgttaccgggtaacccggtacgggtttaccgggtaccccgggttacccgggggggtaccccttaacccggtttttccccggggaccccggtttacgggggaaccccgtaaggggttaccggggtaacggtaaccgggttaaccgaaaaacccgggtaacgttaccggggtaccggtacccgttcgggaacccttaacccgtacgttacccggtttacgttccctttaacccg

SEQ ID NO: 263060 - DNA, 540 bp, Homo sapiens
  misc_feature: GYAE6OF02I166M.8.33.C11.1.454.CMB.1.raw
  modified_base (321)..(321): a, c, t, g, unknown or other
  misc_feature (321)..(321): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgcaaactccaggcaaggggnttggagtgggtggcagttgttcatctgagggcagtgtcaatggtatgctgacgcgtgaggcgatcacatctccagacgacaactccagaacacaatgtattggagctgaacagacctaagtccagacggacgacgggactatacgtacgtcggtaacggaagggaagggggaaccaggacgggtacgttaccgaagtaccgtaccgttaggacgtcggg

SEQ ID NO: 263061 - DNA, 724 bp, Homo sapiens
  misc_feature: GYAE6OF02FEQ60.8.33.C11.1.454.CMB.1.raw
  modified_base (258)..(258): a, c, t, g, unknown or other
  misc_feature (258)..(258): n is a, c, g, or t
  modified_base (343)..(343): a, c, t, g, unknown or other
  misc_feature (343)..(343): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
  modified_base (552)..(552): a, c, t, g, unknown or other
  misc_feature (552)..(552): n is a, c, g, or t
  modified_base (661)..(661): a, c, t, g, unknown or other
  misc_feature (661)..(661): n is a, c, g, or t
tcagctcgcgtgtccacgaccggtgctcgatttagagtgagctcgttgggttggggagaactgctctagttaggacccagagggaaccagtcggaacgccccagctcagcttcgtcttcctcctgctactcgtggcctcccagttcagactaccgacggagtagtattcggtcgttacgacctacgtacgttcctccgacgtccctacccgttgttcctttacggccgtaccggaacgggtaacgcctccctaccctntccgtagccgtaggcctagtcgagtacgtcggtcggcctcgttacggatcgtacgaaccaacaaccgtacgtcggacgacgtccnccgacgccctagtacgtcgtacgtcggtacacctacgtaaccgtacgccgacctcggtcgacctaccgtccgtaccgtacggttacgccgtaagggtcggtaacgtggggttacgtaggtaccgacgtaacgttctaccgaccgtacgaccacgttaacncacgtcgaccgnggtcgaacgtcgaagtctcggttagactacggttttntactacggtactaccgcgttcgtaccggacgttcggccgtcccgggtacttcccgttacggtccgaccgttaagggacaacgggtactacaccggtaacgttaaccggnggtaacccgtcgtccgtaaccgccggttaccttacgttccgtacttccgttaaccctccccgg

SEQ ID NO: 263062 - DNA, 638 bp, Homo sapiens
  misc_feature: GYAE6OF02I9U8N.8.33.C11.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaancgccacctctcctgcaggccagtcagatgtgcncttganctgtacacacaactgcagctccacgccctnatctatggtncatccgaagacggccacgtcgcactcccagccaggttcgagtcggcgtaggtgggtagtcgggganacggtacttcgtacgttctaccacctagtccaagtccgacgtccgtacggacgtccgtaagaacgtgttaggttccgatttaaggttttacttaccgttagtaaccctaacgtacgtaccggtaaccgtaggttccggtccccgggtacccgggggttacccttacggttcccgggtacccggtaccggggtaactaacggggtcggaacggtaccgtaaccgaaaacggtaccgtacggtcggaccgtcggaccaccgttctacggtcgttaccttccgtaccg

SEQ ID NO: 263063 - DNA, 630 bp, Homo sapiens
  misc_feature: GYAE6OF02GZILT.8.33.C11.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagatgtggcncttcgaagctggtaccaacacaaacctggccagctcccacggcccctnatctatggtncactccgaacgacgggccacgtggccacgtcccagcccgtaggttcaggtcggacaggtgggtagtgggacagtacttcactcctcacctatcactcacgtccgtaggacgtccgtagaagtacgttgttacgtacttagtttacttacgtacgtactaactacgtaccggtacgacggtccggtcccggtccgggggtacccttaccggttttccgggtcccggtacgggtaacccgaacgggttacgggacggtaacgtaaccgtaaacggtaacgttagggtcggacgttcgaccgtacctacgttcgtcgttccgttacttaccg

SEQ ID NO: 263064 - DNA, 595 bp, Homo sapiens
  misc_feature: GYAE6OF02GMVL8.8.33.C11.1.454.CMB.1.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtagtccagcctgggagtcacagagactctcctgtgcagcctgtggttcaccttnagtagctacggnatgcacgtgggtcccaccaaactccgaggcaagggtattgggagtggggtgctagttgttcattcgtggacggggctaggttgttacgaagttcggtatcgcgtggaccgtaccggtaggaacgggccgtattccaccatcctaccgagacgaaccaaccgtccaaggaaccaacaattgtattcggacctagaacacgtacctaacgtccgagacgacgtacggtatagtactacgtagaacgggaagggacggggaacagggacggtagtaccgacgtaccgttcgttagtacgtcggtacggg

SEQ ID NO: 263065 - DNA, 709 bp, Homo sapiens
  misc_feature: GYAE6OF02F2J48.8.33.C11.1.454.CMB.1.raw
  modified_base (291)..(291): a, c, t, g, unknown or other
  misc_feature (291)..(291): n is a, c, g, or t
tcagctcgcgtgtccacgaccggtgctcgatttagagtgagctcgttgggtttgggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccnccaaactccaggcaagggattgggagtggggtgctagttgtttcatcgtggagggctagttgttcaagtggtatgcttggaccgtccgtagaacggggccgtagtttaccacctacgtcctaccgaagaacgaaccaaccgtcccgaaacgggaaaccaacgtaaacgttacggttaacgttttacggaacccgttagaaaccgtacgtacccgttaaaggttcccgtaggacgggtaaccgtacggggttacgttaagttaaccgtacgttacgggtaacgggtaaagggggtacggggggaaacccgtaggggaccggggtaacgtttacccggtaaacggtttaccgtttacccgtttacgggtaccggttccggtaccgggggtacccggtaccggggttacccgttaccgggg

SEQ ID NO: 263066 - DNA, 567 bp, Homo sapiens
  misc_feature: GYAE6OF02FSC0C.8.33.C11.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (373)..(373): a, c, t, g, unknown or other
  misc_feature (373)..(373): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagaatgttggcgccttcgaagctggtaccaacacaaacctggccaggctcccaggcccctnatctatggtgcatccaacagggccactcggacactcccagccaggttcaggtgcagtgggtatgggacagcttcactcncaccatcatcagcctggacgtcctgaagtatgttcgctaagtttattacttgttaccaacgtattaccgtacgtacgttacggcccgtccgggggcctacgtttccggccgtcggaccgtaagttacgggagtacgacgtaaaccggtaacgtcggtacggctcggactacgtagtccgtgttccttactaccg

SEQ ID NO: 263067 - DNA, 564 bp, Homo sapiens
  misc_feature: GYAE6OF02FL4W8.8.33.C11.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttcgaagctggtaccaacacaaacctggccaggctcccaggccccctnatctatggtgcatccaacagggccactggcatcccagccaggttcagtgcaggtgggtatgggacagacttcactctcaccatcatcagcctggacgcctgaagatgtcgctagtttacttactagtcaactactacgtaccgtagtcggtccgtccggggtcctacgtttccggtcccgtacgggaccgtaagggtcggacgtactaccgtaaacggtaacgtcggtacggcgtacgaccaccgtacgtcgttcgttcgttactacg

SEQ ID NO: 263068 - DNA, 625 bp, Homo sapiens
  misc_feature: GYAE6OF02G2807.8.33.C11.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgtggcnccttcgaagctggtaccaacacaaacctggccaggcctcccacggccccctnactctatggtcgcactacccaacgacgggcccacgtcggccactcccagccgaggttcaggtggacaggtgggtatgggacagacttcactcncacatcatcacgtcctaggacnccgtagaagtgttgtagcttagtttacttacgtgttacaactacgtaccgtaccgtaggtccggacccgggttcccggggtaccttaccggtttcccgggacccggttacgggtaaaccgtagggtcggacgttacgtaaccggtaaaccgtacggttgggtacggaccgttcggaccctaccgtgttacccgttcgttacttaccgttaccg

SEQ ID NO: 263069 - DNA, 602 bp, Homo sapiens
  misc_feature: GYAE6OF02HAKQ9.8.33.C11.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgtgcncttcgagctgtacaanagaacctggccaggctccagcccctnatctatggtgcatccaacgacgggccacgtggcactccccagccaggttcaggtggcaggtgggtatcgggacacgtacttacgactcctccacctatcatcacgccgtgggacgccgtggaggtattggttgacgttagtttacttacgttgtactaactattaccgtacgtacggtcggtccggtcccgggggtccttaccgtttccgggaccccgtagggaacccgtaaggtcggtattacgtaaccgtaaacgtaccgttaggtcggtaccgtacgaccgtaacctagttccgttcgttaccttactacccg

SEQ ID NO: 263070 - DNA, 850 bp, Homo sapiens
  misc_feature: GYAE6OF02FFGPC.8.33.C11.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
tcagctcgcgtgtccacgaccggtgctcgatttagagtgagctcggttggggtttggggaggaactgctcagttaggacccagagggaaccatggaacgcccagctcagcttctcttcctcctgctactctggcctcccagtttcagataccacggagagtattgtgttgacacngtcctccagcccacctgtctttgctaccgagggaacncgcctaccctntccgtgccgtagggccaggtcaagtaatggttacggccttccgttacggtaatccgtaggtaacccaacgaaccaaaccgtcggaccaacgggtccctaccccgacggtcccccctacacttccgtagtcgggtcgacacgtacctactaccgacggggaccctaccgtagggtccaccgttaccccgaacggtcccgttaagggttaccgtaacgggtcgggtaccgtaacgggttcggggttaccggttacggggaacctacgggttaccctttacgtacccttccttacccaacccgtacgtacccgtaacggaccgaacggttcctaaacggtaacccggtcccgttaaggtaaaagtttacgttttacggaaccgttttaacggtttttaagttacccttacggtaccctaaacgtacggttaccggtacgggtacgtccggggtcccggtcccggggacctttacccgggttttcccgggaacccgttacgggaaaccttaaacggttacggtaaccgtaagaacccggtaaaacggtaccgtacgggttaccggtacctacccgggtaaccttacccgtaaacgtttcccgttacgttacccggtttaaccttcccccgg

SEQ ID NO: 263071 - DNA, 578 bp, Homo sapiens
  misc_feature: GYAE6OF02HGQMT.8.33.C11.1.454.CMB.1.raw
  modified_base (358)..(358): a, c, t, g, unknown or other
  misc_feature (358)..(358): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtggcgcctacgtatcctggtaccaacagaaacctggccaggctcccaggccccctcatctatggtgcatccaacagggccactggcatcccagccaggttcagtggcaggtgggtangggacagacttcactctcaccatcatcacgcctggacgccgtgaggtatgttgcgtaggtttattacgtgtacaactatcggtaccgtggtcggtccgtccgggggtcctacgtttccgggcccgtcgggaacctaaagggtcggtactaacgtacgtaaacggtaacgttggtaggaccgttacgaccgtaccgacttccgtacgtttccttcttaccg

SEQ ID NO: 263072 - DNA, 540 bp, Homo sapiens
  misc_feature: GYAE6OF02HNDE7.8.33.C11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagaatgtgcncttgagctggtacaacacaactgccagctccaggcccctcatctatcggtgcactccaacacgggccacgtggccatcccagccaggttcaggtggcaggtggatgggacagcttcactctcacatcatcagctggacnctagaagntgtgctagtttattactgtacaactntccgtacgcggtcggcccggtccggggcctaccgtttccggccgtcgggaaccgtagggtggagtacgtaccgaaacggtacgtggtacggtcgtgaccgacacttctacgtcttactccg

SEQ ID NO: 263073 - DNA, 548 bp, Homo sapiens
  misc_feature: GYAE6OF02FKHOM.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagaatgttggcgccttgtaagctggtaccaacacaaacctggccaggctcccaggcccctcatctatggtgcatccaacagggccacgtggccatcccagccaggttcagcggcagtgggtatgggacagacttcactctcaccatcatcagcctggacgcctgaagtatgttgcgtagtttattacttgtactaactatccgtaccgagtcggcccgtccggggcctacgtttccggcccgtcggacgtaagggtggacgagtaccgaaacgtaacgtggtggctgactacctcgttctcgttcttctaccg

SEQ ID NO: 263074 - DNA, 797 bp, Homo sapiens
  misc_feature: GYAE6OF02IWTJ1.8.33.C11.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgctccagggaaangccacctctcctgcagggccagtcagaatgttggcncttgaagctgaccacacaaactgcagctccaggcccctcgatctatggtcgcactcccaaacgacggggaccccaacgttcggacctacgtccccaacggccccgtaagggttttaccaacgggttcgggaccgtaaggggtttacgggggttaacgttagggggaaccctaagggtaaccctttaccgtacccgttacctttacccaaacccgtacttaccgtaacttaccgacggtaccccgttaggggacccgtcccgttaagggaaacggttaacttcgggttttacgaccgttttaacggtttttaacttttaaccgtttggtaacctaaaaccgttacggttacccggttaaaccgggtacggttaccggggttacccccggtttacccgggggggtacccttaacccggttttcccggggtcccccgttaacgggggtaaacccgaacgggtttacggggtagtaaaccggtaaccgaaaacggttaaccgttggggtacgtaccgttcgacccgtaccgattcccgtggtttacccttcgtaacccg

SEQ ID NO: 263075 - DNA, 591 bp, Homo sapiens
  misc_feature: GYAE6OF02G4JTO.8.33.C11.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctccagtttcagataccaccggagagattgtgttgacacagtctccagccacctgtctttgctccgaggggaaanagccaccctctcctgcagggccagtcagatgtgcncttgagctggtaccaacacaactggccaggcctccaggcccctnatctatggtncatccaacgacgggccacgtggcactcccagcctaggttcaggtcgcaggtgggtatgggacaggacttcactctcacntcatcagcctggacncctagaacgtattggttacgacttaaggtttattacgtgttacaaactatccggtaacgacggtcggtcccggtccggggtaccttaccgtttccgggccccgtagggaacccgtaggggttcggacgtacgtaaccgaaacggtaaccgttggtacggtacgtcgaccgtaccgtagttcccttagttccttactaccg

SEQ ID NO: 263076 - DNA, 550 bp, Homo sapiens
  misc_feature: GYAE6OF02GR8GN.8.33.C11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
  modified_base (453)..(453): a, c, t, g, unknown or other
  misc_feature (453)..(453): n is a, c, g, or t
  modified_base (500)..(500): a, c, t, g, unknown or other
  misc_feature (500)..(500): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccacctctcctgcagggccagtcagaatgttggcnccttcgaagctggtaccaacacaaacctggccaggctcccacggcccctnatctaatggtgcactccaacgaggggtcccaacgtggacactcccaggccaggtttcaggtggcagggtgggtangggacaggtacttcgactctcacatcatcagctagagctagaagntgtgacgtagtttattctagtacaactactacgtacgngtacggtccgtccggggcctacgttccggccgtcggaaccgtagggngacgatacgaacgtacgtggtagcgtcgacacgatcgtntccgtntaccg

SEQ ID NO: 263077 - DNA, 561 bp, Homo sapiens
  misc_feature: GYAE6OF02JKF3W.8.33.C11.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
tcagctcgcgtgtccacgaccggtgctcgatttagagtgagctcgttgggtttgggggtaggaacgtgcgtcagttaggacccagagggaaccatggaagccccagctcagcttctcttcctcctgctactctggctcccagtttcagataccaccggagagattgtgttgacactagtctccagccacctgtctttgctccgagggaaangccaccctntcctgcagggccagtcagaatgtgcgcttgaagctgacanacaactgcagctccagccctnatcatggncataccanggccacgtgcactccagccaggtcagtggcnggtggataggacagtcttacacttcgccacatcatcacgtccgtgaacgtcccgtagagtactggttacgcttaagtttagttacctagttacaactagtaccgtaccgaggttcgacccggttccggggaccttccgtttacggccccgttagggaaccagggttcgagtaacgtaccggtaaacgagtgtccggacttggaccttaccacgtccgttagtccttaccgtcg

SEQ ID NO: 263078 - DNA, 552 bp, Homo sapiens
  misc_feature: GYAE6OF02JABAT.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggccccctcatctatggtcgcatccaacgagggcccacgtggcactcccagccaggttccagtcggcaggtgggtatgggacaggtcttcacgtctccacatcatcacgccgtggacgctgaagattgttgctagtttattactgtacctaactactcgtacgtagtcggcccgtccggggcctacgtttccggccgtggaccgaggtacgagactacgaaacgtactggtcggctcgacactactcgtcgttccttctacc

SEQ ID NO: 263079 - DNA, 699 bp, Homo sapiens
  misc_feature: GYAE6OF02I1WZ9.8.33.C11.1.454.CMB.1.raw
  modified_base (212)..(212): a, c, t, g, unknown or other
  misc_feature (212)..(212): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtctccagcccaccctgtctttgtctccgaggggaaancgcccaccctctcctgcgaggccagtcaagaatgttggccgtccgttacgtaagctacggtaccaacaaccaaccgtggaccacggcctcccgacggtccccctcactcgtatggcncactaccacgacggaccacgngccatacccgagtccgtaggttcaggtcggacgtagggtggtagtacgggacagtaccttcaccgttcctacccgaactaccttacactacgacgtccgtacgggactcccgtagaacggtattcgtacgtacgttaagtttacttacgtacgtaccgtaactacgttaccggtaccggtcggttaccggtaccccgggtaccggggtcccttcccggtttaccggccccggtagggaacccggtaagggttcggacggttacgtaaccggtaaaccggtacgttcggggtacgtacgtccggaccgtaccctaccggttccgttaccggttacccttaccggtacccg

SEQ ID NO: 263080 - DNA, 643 bp, Homo sapiens
  misc_feature: GYAE6OF02GMQJN.8.33.C11.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcgagggccagtcagaatgtggcncttcgagctggtaccaacacaacctgcaggcctccaggcccctnactctagtggtgcactccaacgagggccacgtgcactcccagcctaggtcaggtgacgnggtggtagtgggacagcttacactctacactacncgactcgacgcctggcaccgtaggaacgtaagttcgttacgtcttaacgtttagttacgttagtacctaacgtacgttaccgtaccggtacggtacgggtccccgggtaccgggggcccttaaccggtttcccggccgggtttaacgggaacccggtacggggtacggtagtaaccggtaaccgtaaaccgggttaacttacggggtcgtccgtacgcccgtaaaccgtcgtttacgtccggtttacttcgttaccccg

SEQ ID NO: 263081 - DNA, 671 bp, Homo sapiens
  misc_feature: GYAE6OF02FXQ9L.8.33.C11.1.454.CMB.1.raw
  modified_base (299)..(299): a, c, t, g, unknown or other
  misc_feature (299)..(299): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagcctctgggttccaccttcagtagctacggcatgcactgggtcccnccaaactccaggcaagggattgggagtgggtggctagtttgtttcatcgtggagggcagttgttacaatggtatgctgaccggtccgtggaacgggccgattaccgacctatccgtaccaagacgaaccaaccgtcccgaacggaaccaacgaattacggtagtttacggaccctagaaacgacgaccttaaacggtccgttaggacggtacggtacgggtacgttaactaaccgttaccgttaggtaaccgggtaacgggggaacgggggtaaacccggaaggggtacccggggttaacggttacccgtaaacgggttaccgttttacccgtttaacgggacccggtttacgggtaccggggtaccccggg

SEQ ID NO: 263082 - DNA, 672 bp, Homo sapiens
  misc_feature: GYAE6OF02G3SRO.8.33.C11.1.454.CMB.1.raw
  modified_base (220)..(220): a, c, t, g, unknown or other
  misc_feature (220)..(220): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagataccacggagagattgtgttgacacagtctccacgccaccctcgtctttcgtctccacggggaaagagccaccctctccngttcacgggccacgtcagagtgttacctacccaacgttacgccgtcggtaacccgtaaccaaccaaaacccttacgggcccgacggaccgttccccacgggacccccctccaccttctttgatcgacatccatcacgggccacgtcgcacgtcccacgcctacggttcgagttcggcgtagtcggggtcgtgggacagtactacgtacctcgtcctaacctacgtccagaccgacgtcccgtaagaccgtcccgtaggtaacgttacgttttagacgttaaggtttacttacgttgtaccgtaactacgtcgtaacccgtggaccggtcggtcccgggcctccgtttccggaccgtcgggtaacctaagttcggaatacgtacgaacgtacgttaggtcggcgttacgctaaccgtctccgttcgttaccttccacttaccgtcccctaccg

SEQ ID NO: 263083 - DNA, 758 bp, Homo sapiens
  misc_feature: GYAE6OF02IMQE8.8.33.C11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccaccctctcctgcagggccagtcagaatgttggcnccttgaagctggtaccaacacaacctggccaggcctcccacggccccctnactctagtggtgcctaactccaacgacgggccacgtggccactcccagcccgtaggttccaggtcggacgaggttgggtacgtagggacaaggtaccttaccaccttaccgtaccaaccctagtaccacttaccgacgtacccgtagggaccgtacccgtaggaaacgtagttcgggttacgtaccgttaaggtttttaactttaacccgttacgttaaccgaaaacgttaccggttaacccgggtttaaacccgggtacgggttaacccggggcccccgggtttaccccgggggggtacccctttaacccgggttttccccggggtaacccccggggttacggggaaacccgggttaacggggttacgggtacggtaaccgtaacggaaaaccggtacgttcgggtacggtacctcggtacccaaccgtacgttaccgtcgttaccttaccgttacccg

SEQ ID NO: 263084 - DNA, 616 bp, Homo sapiens
  misc_feature: GYAE6OF02G904A.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggaccaggcctcccacggccccctcactctatggtgcatacccaacgacgggccacgtcggaccactcccgagccaggttcaggtggcaggtgggtatgggacagtacttcgactcgtcactatcatcagtccgtaggacgccgtagaacggtagttgttcgacgttaagttttacttacgttcgttacaactacgtaccgtacgtacggtccggtacccggtccgggggtacccttaccggtttcccggcccggtagggaacccgtagggtcggacgacgtacgaaacggtaacgttggtacggtccgtcgaccactacgttcttcgttccttctaccg

SEQ ID NO: 263085 - DNA, 634 bp, Homo sapiens
  misc_feature: GYAE6OF02G4M33.8.33.C11.1.454.CMB.1.raw
  modified_base (448)..(448): a, c, t, g, unknown or other
  misc_feature (448)..(448): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtctccagccaccctgtctttgtctccgagggaaagcgccaccctctcctgcacgggccagtcagtatgttggctccttacgtaagctggtaccaacacaaacctggccaggcctacccgacggccccctcactctagtggtcgcactaccaacgacgggcctacgtcggccactcccacgccgtacggttcaggtcggcgtaggtgggtagtggggacagtacttcgacctccacctacctactccatccacgccgtagggcaccgtgaagtnttcggtgtacttaggtttattacgtagtaccaactacgtaccgtacgtacggtccgggtcccggtccggggtccttaccggttccgggacccggttagggaaccgtagggacgtagaacgtaaccggaacggtaacgttggtacggtcctacggacccacgtacttcgtacgtttctacctacccg

SEQ ID NO: 263086 - DNA, 741 bp, Homo sapiens
  misc_feature: GYAE6OF02JD620.8.33.C11.1.454.CMB.1.raw
  modified_base (456)..(456): a, c, t, g, unknown or other
  misc_feature (456)..(456): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccgaccggagagattgtgtagacacaatctccagccacctgtcttcgtctccgagggaaagcgccaccctctccgtgcgagggccagtcaagatgttcggcgtcctagtactccgtacggtaaccaacgaacgtaaaccgtcggacccgtaggaccgtaccccgaacggtccccctacacgttctaacgtcgggttcaccgtaactacccgaaaacgccgggacctaacgtcggacctactacccgacggccgtacggttcgaggtcggacgtagggtacgggtagacgggtacaacgttacgtacncgttaccacgtaccgtactacgactaccgacggtccgtagggtaccacggttaggaccggtattcggttacgactttaggtttactacgtacgtacctaacgtcgttaccggtaacgtcgggtaccggttacccgggtccggggttaccctttaccggttacccgggcccgttaaggggtaaacccttaaggggtccgttaacgttaccggtaaacgtaaaccggtacgttcgggtccgtacgttacgaccgtacgttacgtccggtacgtttacctcggtaacc

SEQ ID NO: 263087 - DNA, 552 bp, Homo sapiens
  misc_feature: GYAE6OF02I5L4Z.8.33.C11.1.454.CMB.1.raw
  modified_base (164)..(164): a, c, t, g, unknown or other
  misc_feature (164)..(164): n is a, c, g, or t
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
tcagctcgcgtgtccacgaccggtgctcgatttagagtgagctcgttgggtttgggggaggaactgctcagttaggacccagagggaaccatggaagccccagctcagcctctcttcctcctgctactctggctcccagtttcagataccaccggagagattgngttgacacagtctccagccaccctgtctttgtctccgaggggaaangcccaccctctcctgcagggccagtcagaatgttggcgccttcgaagctggtaccaacacaaacctggccaggctcccaggccccctnatctatggtgcatccaacngggccactggcatcccagccaggttcagtggcngtgggtangggacagacttcactcncacactnatcagcgtggancctagaagtatggttgcgttagtttattacgtntacaactactacgtacgacgtcggcccggtcccgggggcctaccgttccggcccgtcggaaccgagggtggagacgtacgaaacgtcgtaggtcgcgtagactaccgattcgacgttctcgtacc

SEQ ID NO: 263088 - DNA, 580 bp, Homo sapiens
  misc_feature: GYAE6OF02JAWN3.8.33.C11.1.454.CMB.1.raw
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (386)..(386): a, c, t, g, unknown or other
  misc_feature (386)..(386): n is a, c, g, or t
  modified_base (464)..(464): a, c, t, g, unknown or other
  misc_feature (464)..(464): n is a, c, g, or t
  modified_base (518)..(518): a, c, t, g, unknown or other
  misc_feature (518)..(518): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaagngccaccctctacctgcacggccagtcagaatgttgctccttcgtaanctggtaccaacacaaacctggccaggctcccgacgcccctnagtctatggcnactccaacgnggccactgcacgtcccagtccaggttcagtgcaggtggagtgggacagaccttgactccacgacctanctaatccgaacgtccgtaggcgtccgagtagtatggttacgcttaaggtttatctagtacaactacgtcgtaaacggngtccggtcccggtaccggggcttccggttaccgccgtacgggaacgtacgggtnacgacgtacgtaaagtcgtcgtcggtacacgttaccacgaccttgccgtttacgtctacccg

SEQ ID NO: 263089 - DNA, 605 bp, Homo sapiens
  misc_feature: GYAE6OF02H42B5.8.33.C11.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (282)..(283): a, c, t, g, unknown or other
  misc_feature (282)..(283): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggcctcccagtttcagataccaccggagagattgtgttgacacagtctccagccaccctgtcttgctcgaggggaaancgccacctctcgtgcgaggccagtcagaatgttggcncttgagctgtaccaanacaactgcagcnccgagccctnntactnggtcnctactaccgaacgacggccacgtcggctactcccgagccgtaggttcaggtcgcgaggtgggtagtcggacagacttcgactcactaccatacgactacgacgtcgtgggactcgagaagtattagttgacgttagtttaacttacctaggtacctaacgattaccggtaccgtaggtccgggtaccggtccccggggtaccttaccggttccggtacccggtaggaaaccgtagggtcgacgtaacgtaccggaaacggtaccgtgggtcgaccttggaccgtaactgttacgtcgttactcgttaacccg

SEQ ID NO: 263090 - DNA, 541 bp, Homo sapiens
  misc_feature: GYAE6OF02GMEPU.8.33.C11.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcaggccagtcagatgtggcnccttgaanctgaccanacaactgcaggctccaggcccctnatctatggtncatccaacagggccagtggcactcccagccaggtcagtggcagtggtatgggacagactcactcncacatcatcanctggacgctgagatgttgctagtttattacttntacaactactacgtacgaggtcggccgtcccgggggtacctaccgtttccggcccgtacgggaaccgtaaggtacggtacgtagtaacgaaaacggtaactacggtacggctagaccacgtattcgtcgttacttctaccg

SEQ ID NO: 263091 - DNA, 780 bp, Homo sapiens
  misc_feature: GYAE6OF02JTIT4.8.33.C11.1.454.CMB.1.raw
  modified_base (260)..(260): a, c, t, g, unknown or other
  misc_feature (260)..(260): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggtttcctcgttgctcttttaagaggtgtccagtgtcgaagtgctaactgggtggactcgtggggggaggcgtagtccagccgtgggaggtcacgagatacctctcctggtacnccagccctctgggttccacttctagtacgctacggcatgctacgtgggtcccaccgtaaactcccgtaaggccgtaaaggggtacttcgggaagggtttggggtacgggccgtaagggttttcggtttaccgtaacggttccgtaagggtaacggggtccgtaaggttacgtttaccgtaaaggttggggtttaactcggtcgtacgggtaccgggtccggtttagggaaaccgggtaccggtacgttaccgtaaccgtacgtaccgttaccacggtaacggacctaaaccgtccgaacggaaaccgaacgtaaagttacgttaacgtttacggaacccgttacggtaaaccaacggttacccgtaacgtaccgttacggaacgggtacgtaacgggttcgtaacgtacttaacggtacgtaacgggaacgggtaacgggggaaccacgggtacgggttaacgtaaccggtaacgttacggttaccgttacggtaccggttacgggtcgggtaacccggg

SEQ ID NO: 263092 - DNA, 680 bp, Homo sapiens
  misc_feature: GYAE6OF02I4XLK.8.33.C11.1.454.CMB.1.raw
  modified_base (208)..(208): a, c, t, g, unknown or other
  misc_feature (208)..(208): n is a, c, g, or t
  modified_base (299)..(299): a, c, t, g, unknown or other
  misc_feature (299)..(299): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccacctgtctttgctccaggggaaangccacctctcctgcagggccagtcagaatgttggctccttcgtaagctggtaccaacaacaaacctggccaggcctcccgacggcccctanactctagtggtcgcactaccaacgacgggccacgtggacacgtcccaggcctaggttcaggtcggacaggtgggtacgtgggacaggtaccttcacgtcctacaacctatcacgtacacgtccgtaggacgaccgtagaaacgtacttaggttacgacgttaagttttaactttacgttacgttaacctaacgtacgtaccggttaaccggtaaggtccggtcccgggtacccgggggtaccttaccggtttcccgggacccgttacgggaaaccgtaacggggttacggaacgtaacgtaccggaaaacggttaaccgttacgggtacggtccgttacgaccgtaaccgtacttaccggttacgttaccttaccgtaccc

SEQ ID NO: 263093 - DNA, 696 bp, Homo sapiens
  misc_feature: GYAE6OF02H4CI2.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagaatgttggctccttcgtaagctggtaccaacacaaacctggccaggcctacccgaggcccctacatctatggtgcactaccaacgacgggccacgtcggaccacgtaccccgacgtcccgtacggttcgaggttcggaccgtagggtttggggtaacgttcggggaaacctaaggtaccctttacaaccgtttcctacccgaaacctacgtacctaacgtccgtaccgtacccgtagggactccgtaaggaaggtacttggttcgtacttaggttttaacttacgtcgtaacaacgtactaccggtaaccggtcgggttaccgggtcccggtcccggggtaccttaccggtttcccgggacccgtagggaaccgtaggggtacgacgtaacgtacgaaacggtacgtcggtacggtacctggaccgtacctacgttccgttacggttacctacgtaccg

SEQ ID NO: 263094 - DNA, 727 bp, Homo sapiens
  misc_feature: GYAE6OF02GBQFA.8.33.C11.1.454.CMB.1.raw
tcagctcgcgtgtccacgaccggtgctcgatttagagtgagctcgttgggtttgggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagcctcgtgggttcaccttcagtagctacggcatcgacacgtcgggtcccgacccaaaacctccgagggacaaggggtacttgggaggtggggtggcttaggtttgtttacattcgtggagggctaggttgttacaagttggtaatggacttggacggtccggtaggaacgggtcctagtttccaacctacgttacctaccgaaggacgtaacctaacctacccgaaacgggaaaccacgtaaagttcggttaacgtttacgggaaccctaagaaacgaccgtaacctaacggttcccgtaggaacggtaccgtaacggggttactaacgttaacgttacggtaggtaaaccgggaagggggtaaccgggggaaccgaggggtacccgggtaacgtttaacccggaaacgtttaccgttaccgtttacggtaccgggttaccggtacggggtacccggtacggggttacccgttaccggg

SEQ ID NO: 263095 - DNA, 763 bp, Homo sapiens
  misc_feature: GYAE6OF02HTA0K.8.33.C11.1.454.CMB.1.raw
  modified_base (211)..(211): a, c, t, g, unknown or other
  misc_feature (211)..(211): n is a, c, g, or t
tcagctcgcgtgtccacgaccggtgctcgatttagagtgagctcgttgggtttgggggagggaacgtgctcagttaggacccagagggaaccatggaagcccagctcagcttctcttcctcctgctactctggctcccagtttcagataccaccggagagattgtgttgacacagtctccagccaccctgttcttgtctccgaggggaaanagccacctctcctgcagggccagtcagaattgttcggcgcctttgaagcttaggacctaacacaaacctggaccaggcctcccacggcccctgactctaatcggtcgctactaccgaaacgacgggtaccccaggttcgggctactccccgtacggcctaagggttcacggtcgggacctaggggttaggggtactggggaaccgtaggaccgtttacaacggttcctaccgtaaccgactttaccgactacgtacgtaccgttacggacgtacccgtaggaaacgtacgttaggttggtaaccttaagtttaacgttacgttacgttacctaaacgtacgttaccggtaacgtacggttacgggtaccccggtacccggggggttacccttaccgggtttaccgggtaccccggttaagggaacccgttaaggggtaccgggtaacggtacggttaaccggtaaaccggttaaccggagggttaccggtaccggttacggtacccgtaaccggtaacgtttcccggtaaccgtttcgtacccgttaaccgg

SEQ ID NO: 263096 - DNA, 683 bp, Homo sapiens
  misc_feature: GYAE6OF02FJB0X.8.33.C11.1.454.CMB.1.raw
  modified_base (324)..(324): a, c, t, g, unknown or other
  misc_feature (324)..(324): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctccccgaggccccctcatcctatggtgcactccaaacgngggcccacgtcggcactcccacgccgaggttcaggtcggcgtaggtggggtatcggggacaggtacttcgactcctacacctatcaatcgacgccgtggacgtccgtaggacggtattggttgtacgttaggttttaacttaccgttagtaccaaacgttcttaaccggttaccggagggttccggtacccgggttcccggggggtacccgttaccggtttcccggggtccccggttacggggaaacccgttaaacgggtacggtacgttaacgtaacccgtaaaacggtaaccgttcgggttacggaccgttacggaccgtaaccgtattaccggttacgttacccgttacgtacccg

SEQ ID NO: 263097 - DNA, 807 bp, Homo sapiens
  misc_feature: GYAE6OF02JAZ6T.8.33.C11.1.454.CMB.1.raw
tcagctcgcgtgtccacgaccggtgctcgatttagagtgagctcgttgggtttgggggaggaactgctcagttaggacccagagggaaccatggaacgccccagctcagcttctcttcctcctgctactctggcctcccagtttcagactaccacggaaagattgtgtgacacagtctccagccaccctgtctttgtctccgaaggggaaagcgccaccctctcctgcagggccagtacagagttcgtggcctccttcgtaagcttacggaacccaacgaaccaaaccgtcggaccgacggaccttaccccgacggtccccccgtacacgttcctaacgtcgggtagacctacgtacccgaaaccgacgggggcccaccggtggtaccacctaccccgagccgtaagggttcaacgggtcgcgagggttggggtaacgttcgggaacgtacggtaccttccaactcctacctacctaacgtccgtaacgttccaacggtccccgtaggggacctaccggtacggtaagttacgttgggttcggtactttaaggttttaccttaagttacggtaacctaacgtcggtttacccggtaccgggtaacgggttcccggggtacccgggttccccggggtaccttacccgggttttccggggccccgttaacggggaaccgtaacggggtacggttaaccgaggttaaaccggaaacccgggttacgttacggggttaccgtacggttaaccggtacccctaactttaccggttcttacccgggttctttaccgtaccggtttaccccccg

SEQ ID NO: 263098 - DNA, 610 bp, Homo sapiens
  misc_feature: GYAE6OF02ITIU9.8.33.C11.1.454.CMB.1.raw
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (461)..(461): a, c, t, g, unknown or other
  misc_feature (461)..(461): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccgggagagattgtgttgacacagtctccagccacctgtctttgctccgaggggaagagccaccctctcctgcagggccagtcagatgttggcgccttcgtaagctggtaccaacacaaacctggccaggctcccacggcccctnatctatgggtncatccaacgacgggccactggcactcccagccaggttcaggtgcgaggtggtatgggacagacttcactctacacctatcatcacgcctggacgcccgtagaagtagttgttacgacttagttttacttacgtgtactaatactccggtacgnggtcgggtcccgtaccgggggaccttaccggtttccgggcccgttagggaacccgtaggggtacgtagacgtaccggaaacggtaacggttcggtacggtaccgtaggacccgtaccgtaacttccggtgttttaccgtccgttacccg

SEQ ID NO: 263099 - DNA, 657 bp, Homo sapiens
  misc_feature: GYAE6OF02H0ULQ.8.33.C11.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagcccaccctgtctttgtctcgagggaaagcgccacctctcctgcagggccagtcagaatgttggcgccttgtaagctggtaccaacgacaaaccgtggaccaggcccgtccccgggcccctcatcatggncactccaagacggtccactcggactatacccgagtccgtaggttcgaggtcggaccgtagggtagggtacggtagggacctaggtacctttaccgacttcctaccaaccgtatacctacgtaccgtacgtccgtacgggaccgtacgtacgaaggtacgttgttacggacgttagttaacttagtcgtaacaacgtacgtcgtaacggcggtccgggtacccggtccggggccttaccggttccgtccgtacgggacccgtaagggtcgaagtacgaacgtaacgaacggttcggtcggccttagacccgtacgtacgttccgttcgttacttccgtacttccccg

SEQ ID NO: 263100 - DNA, 712 bp, Homo sapiens
  misc_feature: GYAE6OF02IH94F.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcacgggccagtcagaagttggttcggccgtccttcggtaagccttacggtaacccaaaccaacctaaaacccgtggacccgacgggcccttaccccgaacgggtcccccctacacttccttaagtgggtcgactacttacccgaaacgacggggtccctaacgtgggcctaacgccccaaggtaccctagggtttccgaaggttcggccgtaggttaggggttagtacggggacacggtaaccttcgaaccttaccgtccaaccattccaattcgaacgtccctgggacgcctaggaaacgtacgttggttcgtacgtaggttttaacttacgtcgtaacaacgtacgtacgtaccgtaggtcgggtcccggtccgggggccttaccggttccgggccgtacgggacgtaacgggtggacgactaaccgaaacggtacgtcggtaggtctacggaccaccgttagtacgttacgttcttacgtaccg

SEQ ID NO: 263101 - DNA, 720 bp, Homo sapiens
  misc_feature: GYAE6OF02GLUY3.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttcgtaagctggtaccaacaccaaacctggccaggcctccccgacggccccctcactcctatgggtcgcactccaacgcgggccacgtcggcactcccacgcctaggttcaggtcggacgtaggtgggtagtaggggactaggaccttcacgtcctacaccatcatcgacgccgtggacgtcctaggaaacgtacgttggttacgtacgttaagttttactttacgttacgttacctaacgtaacgtttacccggttaaccgggtacgggtacccgggtaccccgggttaccccgggggggtacccttacccggggtttacccgggtaccccggttaccggggtaaaccggtaaacgggggttacgggacggttaaccgtaaccggtaaaaacggttaccgttacgggtaccgggtccgtaccgaccgtacccggttattcccggttagtttacccttccgttaacccg

SEQ ID NO: 263102 - DNA, 633 bp, Homo sapiens
  misc_feature: GYAE6OF02H9F7A.8.33.C11.1.454.CMB.1.raw
  modified_base (163)..(163): a, c, t, g, unknown or other
  misc_feature (163)..(163): n is a, c, g, or t
  modified_base (207)..(207): a, c, t, g, unknown or other
  misc_feature (207)..(207): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgngttgacacagtctccagccaccctgtctttgctccgaggggaanagccaccctctcctgcacgggccagtcagaatgttggcgctcgtagctggtaccacacaaacctggccaggctcccgaggcccctcatctatggtgctatccgaacgacgggccaacgtcggcacgtcccagccgtaggttcagtcggcaggtgggtagtgggactacgtacttcacgtctaccacctatcgatccgacgtcctagggacgtccgtaggaaagtcttaggttacgcgttagttttacttacgttgtaccaacgtagttccggaaccgtcgttccgggacccgttcccgggggtaccttacccggtttccggccgttacggggtaaccgaggggtacgaggtacggtaccgtaaaccggtacgttcgggtacgccgtacggacccgtaccgtactcggttcgttaccttagtacccg

SEQ ID NO: 263103 - DNA, 692 bp, Homo sapiens
  misc_feature: GYAE6OF02H6C0L.8.33.C11.1.454.CMB.1.raw
  modified_base (209)..(209): a, c, t, g, unknown or other
  misc_feature (209)..(209): n is a, c, g, or t
  modified_base (387)..(387): a, c, t, g, unknown or other
  misc_feature (387)..(387): n is a, c, g, or t
  modified_base (684)..(684): a, c, t, g, unknown or other
  misc_feature (684)..(684): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagttttcagataccaccggagagattgtgttgacacagtctccagccaccctgtctttgtctccaggggaaancgccaccctctcctgcgacgggccagtcagaattggttcggctccttacgaagctaggtaccaacaacaaaacctggaccaaggcctccccgacggccccctcgacttctagtcgtcgacactacccaagacgggccaccgtggaccactcccgagtacccgaggttcaaggttcggngtacggttggggtagtcggggaacacggtaccttcacctacctaccaaccgtacttctaactccgaacggtccgacgggtacgtaccgtaaggaaaggtacttaggttcgtcgttaaagtttacgtttactagttaaccaacgtacgttacgtaccggtacggttccgggaccccggttcggggtaccctaccggtttccgggtcccggtacgggtaccgtaagggtaggaccgtaagtaccgaaacggtaacgtcggtaggtcctcgtaccgacgtacttaccgttgttaccgttnttaacccg

SEQ ID NO: 263104 - DNA, 572 bp, Homo sapiens
  misc_feature: GYAE6OF02G3TY5.8.33.C11.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttcgtaagctggtaccaacacaaacctggccaggctcccaggccccctnactctatggtgcactccaacgacgggccacgtggcactcccagcctaggttcagtggcagtgggtangggacagtacttcgactctcaccatcatcacgtccgtaggacgccgtagaagtagttgttgcttaagtttattactgtacaactacgtaccgtacgtacgtcgggtcccggtcccgggggtcctaccgtttccggcccgtcgggaaccgagggtcggagtacgtacgaaacggtactaggtcggcgtgcacgtatcgtcgttctctcc

SEQ ID NO: 263105 - DNA, 682 bp, Homo sapiens
  misc_feature: GYAE6OF02F7U4C.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaangcccacctctcctgcagggccagtcagaatggttgcgtccttacgtaagcgtaggtaccaacacaaacccgtggccaggcctcccgacggtccccctcactctagtggtcgcactacccaaacgacgggcctaacgtggcactccccagccctaggttcaggtcggcgtaggtgggtagtgggacgagtacttcgactctaccgaccatccatccgagtaccgtggaacgtccgtaaggaagtacgttggttacgtaccgttaggttttaacttaccgttgtaaccgtaactacttaccggttaccggtggttaccggtcccggggttcccggggtacccttacggttttccccgggcccggtaacgggtaaccgtaaggggtacgacggtactaacccggtaaacggtaccggttacggtacggtccgtacgacccggtacttccggtccttacggtttcctacgttacccg

SEQ ID NO: 263106 - DNA, 767 bp, Homo sapiens
  misc_feature: GYAE6OF02G10TL.8.33.C11.1.454.CMB.1.raw
  modified_base (167)..(167): a, c, t, g, unknown or other
  misc_feature (167)..(167): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacgttgggttttcctgttgcttcttttaaggnggtgtccagtgtacaagtgacaacgtgggtggagtcggtgggggagcgtagtccagccgtgggacggtcacgagacgactcctccgtggtcgacacgtccttcgttcgggttacctacctttcgaaggttacgccgttacggctagtcggactacggtcggggtacccaacctaaaccgtccggagggaccggtaaaggggtgttggggagggttcgggtcggacttagggtttcgtttcagttcggtgggacgggtactaggttggttacaaggttggtatcgcgtaggacccggtcggtagggaccggtccttactccgaaccgtactcccgtaacgaggaccaacctaaccgtacggaacgaaacctaactagttacgttacgttacggacctacgaaaccgtacgtaccgttaacggtcccgtagggacggtaccggtaacgggttacgttaaccgttacgtaacggttacgggaacgggtaacgggggaaccgggggtaaccgtacggggaaccgggttaacggttaccgttaacgtttcgttaccggttagggtacccggttcggggtacgggtacccggtacgggttaccccg

SEQ ID NO: 263107 - DNA, 579 bp, Homo sapiens
  misc_feature: GYAE6OF02JD4TH.8.33.C11.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaaancgccacctntccctgcaggccagtcagatgtgctcttgaanctgtacacacaactggccagctccagccctnatctatggtncatccaacgcgggccacgtggcacgtcccagcctaggttcaggtggcaggtggtagtgggacaggtacttcacgtctcacatcaagtcacgctggcacgtagaagtagtgtgacttagtttacttacgtcgtacaactagtaccggtacgtagttccggacccgtccggggtccttaccggtttccgggcccgttacgggaaccgtagggtacggtacgtaacgtaaccgaaaccgggtactagggtacgccgtacgaccgtactaccgttcgttacgtacttctaccg

SEQ ID NO: 263108 - DNA, 707 bp, Homo sapiens
  misc_feature: GYAE6OF02FZPBC.8.33.C11.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaangccaccctctcctgcagggccagtcagatgtgcncttcgtagctgaccaacacaacctgccaggctcccgacggcccctcactctatggtgcactccaacgacgggcccaacgtgggaccacgtaccccagcccgtaggtttccaaggttcggacgtaggtagggtacgttggggaacgacgtaccttaccgacgttcctaccaaccctatccaactccgaacgtcccgtacgggaacgtcccgttaggaacggtaacgttcggtttacgacgtttaacggtttttaacttaccgtttacgtaaccaaacgttaccgtaccgggttaaccgtacggtccgggtaccccggttcccgggggtacccttaccggtttacccgggtcccgtaacgggtaaccgtaaacgggttcggacttaacgtaaccgtaaaacggtaccgttaggtacgtaccgtacggtaccaccgttacttccgttacgtttccttacgttacccg

SEQ ID NO: 263109 - DNA, 841 bp, Homo sapiens
  misc_feature: GYAE6OF02GHG6V.8.33.C11.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagagatcattggagaagtggtgatgacacagtctccggtcaccctgtcttgtttttccnggggagagacgccaccctctcctgtgcggcagtcagagcgttaggactaacttagcctaggtatcagcagacggcctggccaggcctccccgagtacctccctcacgttcgtttcgggccgtaccttttaaaccgacggggaccctaaggttacgggaaacctcccccgaacggccccgtaaacgggtttccgaagggcccgggtaccgtaacgggttcgggggtaccgtttacggggggtaaccctttttccgggtttaccctaacccggtttcccttacctaaccccgtaaacttaaccctaaaaccgtttaaaccccgtaggtaaccttaaaccgttcccgtttaacgggaaacccgtttaaccgtttttaggtaaccctttaacggtttttttaaacgtttcccgttacgggttacctaacggttcgtaacgttcgttaaggtaaacgtcgtccgggttacccgtttaccgttaccggttttacggggaccgggtaaggggtaacccggtaacgggttacgggtaaccccgttaaacgaaaccggttaaccgttgggttacggtaccgtacggacctaaccctacgttaccttacggttacctttaccgtacttaccccgtttcccggtacctaagttccg

SEQ ID NO: 263110 - DNA, 676 bp, Homo sapiens
  misc_feature: GYAE6OF02H2NTO.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaangccaccctctcctgcagggccagtcagatgttggcnccttcgtaagctggtaaccaacacaaacctggccaggctcccgaggccccctnactctagtggtgacactccaacgacgggcccacgtggaccacgtccccaagccgaaggttccaggtcggcctagggttgggtaagtcggggacaaggtaccttcaacgttccttccaaccctatccactcgacgcccgttacggacgtcccgtagtaaacgtacgttgttacgtacttaacggttttaacttacgttcgttaactaaacgtagtacccggttaaccggtaacggttcccgggtacccggttcccgggggtacccttaccgtttcccgggacccgtacgggtaccgaacgggttcggacgtaacgtaccgtaaacggtaccgtacggttaggccgtagaccgtacctacgtctacgttacctacgtacc

SEQ ID NO: 263111 - DNA, 773 bp, Homo sapiens
  misc_feature: GYAE6OF02GC6Q8.8.33.C11.1.454.CMB.1.raw
  modified_base (286)..(286): a, c, t, g, unknown or other
  misc_feature (286)..(286): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctccgaggggaagcgcccaccctctcctgcgagggccagtcagaatgtggcgtccttcgaagctgtaccaacacaacctggccaggccncccgacgcccctcactctagtggtgacactaccgaacgacgggaccctacgtcggacctaccgtccccgacgtcccgtaggttcgacggtggacgtagggttaggggtaagttcggggaactacggtaccttacgtaaccttccgtacctaccctactccgtaactccgtaacgtcccgtacgggactacccgtaggaacgttagttacggttcggtacgttaaggttttacttaccggttacgttaaccgtaaacgttacgttaccggttaacccggtacgggttaccggggtccccggggttacccgggggtccccgtttaacccgggttttccccgggtaccccgggttaacggggaacccggttaagggggttaccgggaacggttaaccgtaaccgtaaaccgggtaaccggttagggtacgggtaccctacgggacctaaccgtcggtttacccgttacgtttacccgttacgttacccgg

SEQ ID NO: 263112 - DNA, 650 bp, Homo sapiens
  misc_feature: GYAE6OF02HOJDY.8.33.C11.1.454.CMB.1.raw
  modified_base (178)..(178): a, c, t, g, unknown or other
  misc_feature (178)..(178): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtagtccagcctgggagtcacagagactctcctgtcgcagcctgttggttcaccttnagtagctacggnatgcacgtcgggcccaccaaacgtccgaggcaagggtnttgggagtgggnggctaggtttnttacattcgtggacgggtctagtcgtttacaagttggtatgctaggaccggtccggtaggaaccgggtccgtattccacctatcctaccgagacgtacctaactccgaagtaaccacgtaagttagtacgtttcgacctagaaccgtacgtaccgtaacgtcctaggtacggaaccggtacggtacgttaagtaccttacgtacggtaacgggaacggggtaacgggggaaccgagggtaccgggtacgttaccgtaacggttaccttacccggtttacggtaccggtacggtaccgggg

SEQ ID NO: 263113 - DNA, 798 bp, Homo sapiens
  misc_feature: GYAE6OF02HF9NV.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggagtcacagagactctcctgtgcagcctctgggttcaccttcagtagctacggcagtgacacgtcgggtcccgacctaaaccgtccgagggaccgaaaggggtatttggggaggttgggggtggtcgtaggttttcggtttacagttcgtggacggggtctaggttcgttacaagttggtaattcggtctacgggaccggccggttagggaacgggtcccgtaatttcccaaccgtactccctaccgaaggaacgtaaccctaaaccgtaccgaacgggtaaacctaaccgtaaacgtttagtttaaaccgtttacgggaacccgttacggaaacccgtacggtacccgttaaaccggttaccggtaacggtaacgggtaaccggtaacggggtttacgttaacgttaaccgttaaccggttacgggtaaaccgggtaacgggggtaaccggggggtaacccggaacgggggtaacccggggtaacggtttaacccggtaaacggtttaccgttacccggtttacgggtaccggttaccggggtacgggggtaccccggtaaccggggttaccccgg

SEQ ID NO: 263114 - DNA, 687 bp, Homo sapiens
  misc_feature: GYAE6OF02JW8P8.8.33.C11.1.454.CMB.1.raw
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattggtgttgacacagtctccagcccacctgtctttgtcctccgaggggaanagcccaccctctcctgctacgggccagtcagaatgtggcgccttgaagcgtcggtaccacaccaacctgccacggctcccacgcccctnactcgtactaggtcgctactcccgaaacgtccgggaccaccgtacggcctacgtacccacggcctaacggttctaggcggtccgtaagggtcggggttaagtcgggaactaacgtaccgttccgtaacgtacctaccaaccgtactctacgtaccgtaacgtccgtaggtacgtcccgtaggtaaacgtagttcggttcgtacgttaggtttacttacgttctaacgtaaccctagtccgtaacggtacgtcgggtacccgttacccgggggtaccttccgggtttacccggccgtacgggtaaccggtacgggtacggacgtacgtaacgtaaacggtacgtaggttcggactcgtaccgtactaccgtcttcgttccgtcgtacc

SEQ ID NO: 263115 - DNA, 811 bp, Homo sapiens
  misc_feature: GYAE6OF02H5FSC.8.33.C11.1.454.CMB.1.raw
  modified_base (213)..(213): a, c, t, g, unknown or other
  misc_feature (213)..(213): n is a, c, g, or t
tcagctcgcgtgtccacgaccggtgctcgatttagagtgagctcgttgggtttgggggaggaactgctcagttaggacccagagggaacatggaagccccagctcagcttctcttcctcctgctactctggctccctagtttcagactaccgaccgggagagattgtgttgacacagtcctccagcccaccctgttctttgctcgaagggaanacgccaccctctcctgcagggccagtcagtaagtgttcggcgtccgttgtaacgtcgtacggtaaccaaaccaaccgtaaaccgtggtaccgaacggtccctaccccgacggtccccctacacttccgttagtcggtacgacctaaccgtaccgaaacggaccgggtaccccacggtacggaccctaacccgtccccgaacgtcccggtaacgggtttaccgacgggtcggtaccggtagggttacgggggttaacgtacggggtaaacctacgggttaacctttaccccgaaaccgttcccttaccccgaacctaacgttaccctagtacccgaccggtccgttacgggacgtacccgtaaggaacgtagttcgttcgttaacgttaagttttactttaccttagtacctaaacttacggtaccggttaaccgggtacggtcccggggttcccgggtaccccgggggtccttacccgggtttccccgggaccccgggttacggaacccgggttaggtacggacgtaaccgttaaccggaacgtaacggttcggcggtacacggtcctaccgtacgttccttcgttacctactacccg

SEQ ID NO: 263116 - DNA, 629 bp, Homo sapiens
  misc_feature: GYAE6OF02G9NND.8.33.C11.1.454.CMB.1.raw
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcaggccagtccagaatgttggcgccttcgtaagctggtaccaacaccaaacctggccaggcctcccgaggccccctcactcctagtggtgctactccaacacgggacctacgtcggacacgtccacgccaaggttcacggtggactaggtgggtaatcggggaacngtacttcgaaccttcgtaccaacctatccaatccaacgtcccnggtaaccncgtaagaacgtattcgtacgtcttaaggttttacttacgttaggacctaatacgttacggtacctaagggtcgacccggtccgggggcctaccgtttcgggtacccgtaggaaccgtacggtgaacgtacgtacgaaaccgtaagtcggtacgacgtcggtacaccgtaagtccgtttctctactaccg

SEQ ID NO: 263117 - DNA, 746 bp, Homo sapiens
  misc_feature: GYAE6OF02HMH55.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgcccaccctctcctgcgagggccagtcagaatgttggcgccttacgtaagctcggtacccaacaccaaacctggccaggcctccccacggccccctcactctatggtcgcctactacccaacgcgggcccacgtcggaccacgtcccacgccctagggttccaggtcggcgtaggtaggggtacgtacggggacaacggtacctttaccgaccttcctaccgaccctaacgtcccgtaagtcccgtaaccggtcccgtacgggaccgtccgtaaggaaacgtaactttcgggtttacgtactttaacggtttttaactttaccgtacgttaacccaacgtaaccgttacccgggtaaccgtacggggttcccgggtaccccgggggtcccgggggtacccgttaccgggttttccccgggaccccgggttacgggaacccgtaaggggttggacggtaacttaacccggaaacggtcgttacggtacggtcgtaccggacctaccgtagttccgtacgttacctccgttacccg

SEQ ID NO: 263118 - DNA, 666 bp, Homo sapiens
  misc_feature: GYAE6OF02GKW3Y.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaancgccaccctctcctgcagggccagtcagaatgttggcgtccttcgtaagctggtaccaacacaaacctggccaggcctcccgaggccccctcacttctagtggtgcgtaccaacgagggtcccacgtggcactcccagcctaggtccaggtcggcaggtggggtatggggacacggtacttcgactctccacctactcactcacgtcgtagggacgcctaggaaagtcgttgttagacgttagttttactttacgttacgttaccgaactacgttccggtaaccggacggttccgggacccgggttcccgggggccttaccggtttcccgggcccgttccggggtaacccgtaaggggtcgggaacgtacgtaaccggtaaaccggtaacgttacgggtcggtaccggttacgaccgtaccgtaacttccgtacgttccttaccgtctttaccccgg

SEQ ID NO: 263119 - DNA, 839 bp, Homo sapiens
  misc_feature: GYAE6OF02F9LW9.8.33.C11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcgagggccagtcagaatgttggcncctagtatccgtggtaccaanacgaaacctggaccaggcctcccgacggccccctnactctagtggtncactccaacgcgggaccacgtcgggacctaacgtccccgacggtccccgtaaggttccgacgggttcggtaccgtaggggtagggggttagtacgggggaacctaacgggttacctttaccgaccttaccgttaacccgaaacccgtacttaccgaacgttaccgtaaccggtacccggttagggaacccgtcccggttaagggtaagggtacgtttgggtttacgtaccgtttaagtttttaacgtttaccgttacgttaaccgtaaaccgttacgtttaacccgggttaaccggttacggggttaccgggtcccggggtttaccccggggggtcccgttacccgggtttttacccggggaccccggttacgggggtaaaccccgtaaagggttaccggggtaaccttaacggttaaacccggtaaaccggttaaccggtttcgggtaccgggtacccttaccggacccgtaaccttaccggtttccgtttaaccgggtttacctttacccggttaaccccg

SEQ ID NO: 263120 - DNA, 590 bp, Homo sapiens
  misc_feature: GYAE6OF02I5AKB.8.33.C11.1.454.CMB.1.raw
  modified_base (208)..(208): a, c, t, g, unknown or other
  misc_feature (208)..(208): n is a, c, g, or t
  modified_base (419)..(419): a, c, t, g, unknown or other
  misc_feature (419)..(419): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacaccaaacctggaccacggctcccacggccccctcatctatggtgctatccaacgcgggccacgtggccactcccgagccaggttcaggtggctaggtgggtatcgggacagtacttcgactcgtcacctatccatcacgtctagacgctganatgtgcctagtttatttacgcgtacaactataccgtacgacgtcggcccgtccggggtcctaccgtttccgggcccgtcgggaaccgacgggttggacgtacgtaccgaaacggtaacgttcgtaggacgttaccggacctaccgtacttaccgtcgttccttctaacccg

SEQ ID NO: 263121 - DNA, 554 bp, Homo sapiens
  misc_feature: GYAE6OF02F7NI7.8.33.C11.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctcagccacctgtctttgctcgagggaaagcgccaccctctcctgcgagggccagtcagatgtgcncttgantgacanacaacngcagcnccgcgccnatcatgncactaccacgcggccangcacgtccagccagtcagtggcgaggtggtagnggacagtctcgatccncgaccagctatacgacgcgtaggcncgtagagtattggtactgttagtttactactgtaacaacgtattaccggaacgtcggtcgggtcccggtaccggggtaccttaccggttccggaccgtacgggaacgaacgggtaggatacgaaccgtaaacgtaccgttcggtacggtactacgacgtacctagtcgtacgttctactaccg

SEQ ID NO: 263122 - DNA, 667 bp, Homo sapiens
  misc_feature: GYAE6OF02FEQYE.8.33.C11.1.454.CMB.1.raw
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgctccgaggggaaacagccacctctcctgccgaggccagtcagatgttgcncttganctgaccacacaactggcaggctccaggcccctnatctagtggtcgcactaccgaagacgggaccagtcggcactcccgagcccgtaggttcaggtcgacgtacgggtggtaagtcgggacaacgtacctacgaccttcctaccgacctatccatacgacgtaccgtggaccgtccgtagaacgtagttacgttagacgtttagtttaacgtaccgttagtaacccgtaaacgttacgttacccgggtaacggtacgggtcccggtacccgggttacccgggtaccttacccggtttacccgggacccgttagggaacccgtaacggggtaccggagtaaccgtaaccggaaaaccggtacgtcggttacggctacggaccctaacgtacgttcctacggtttacttaccgttaccccg

SEQ ID NO: 263123 - DNA, 731 bp, Homo sapiens
  misc_feature: GYAE6OF02JSC8U.8.33.C11.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (397)..(397): a, c, t, g, unknown or other
  misc_feature (397)..(397): n is a, c, g, or t
  modified_base (490)..(490): a, c, t, g, unknown or other
  misc_feature (490)..(490): n is a, c, g, or t
  modified_base (681)..(681): a, c, t, g, unknown or other
  misc_feature (681)..(681): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccagtttcagactaccgaccggagagattgtgttgaacacagtcctcgagccacctgtccttgctcgagggaangccacctntcctgcaggtccaggtcagtaagtcgttcggcctcctttacggaagtccgtaggtaaccaaacgactaaacccgtggacctacgggccttccccgacggtccccctagacctcgtaacgttgggtacaccgtacgttacccaaacggtacggcccctagtaccggcctaccgttacccgngtacctacggttacacgggtacgcgtaacggttgggtacgtaggactaacggtactttacgaaccgtttcaccctacccgtaattccgtaacncgtaacgtcccgtaagggtactcccgttaggaacgttattacggttacgactttaagttttataccgttcgtaacgtaaccgtcgttaccggtacggtacggtccggacccgggtacgggtcccgttaaccgttttccgggaccctagggaacccttagggacggttacaagttaaccggaacgttaacgnggttacgaccgttgaccttaacgcctttaccggctttccgacgtttaccg

SEQ ID NO: 263124 - DNA, 533 bp, Homo sapiens
  misc_feature: GYAE6OF02G03JQ.8.33.C11.1.454.CMB.1.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
  modified_base (518)..(518): a, c, t, g, unknown or other
  misc_feature (518)..(518): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagatacccaccggagagattgtgttgacacagtctccagccaccctgtctttgtctccgaggggaaagagcccaccctctcctgcagggccagtcagaatgttggcgccttgtaagctaggtaccaacacaaacctggccaggctcccaggcccctnatctatggtncatccaacgagggccacgtggcactcccagccgaggttcaggtggacaggtgggtatgggacagacttcactctacaccatcatcagctgagcctagaagtatgtnctagtttatactgtacatactcgtacgngtcggtccgtaccggggcctacgttccgccgtggaccgtaggnggagtactacgaaacgactgtagctagacacncgtctacgtctctac

SEQ ID NO: 263125 - DNA, 759 bp, Homo sapiens
  misc_feature: GYAE6OF02HFNX2.8.33.C11.1.454.CMB.1.raw
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggtaccaacacaaacctggccaggctcccaggccccctnatctatggtcgcactccaaacgaggggcccacgtggaccactccccgagacccgtagggttccaggttcggacgtagggttaggggttactggggaactaggtaacctttcgaaccgttcctaccaaccctagtcccataccgacgcccgtacgggacgtacccgtaggaacgtagttggttcgtacttaaggttttactttacgttacggttacctaaacgtacgttaccgttaaccggtacggttccgggtccccggttacccgggggggtacccttaccgggttttaccccgggtaccccgggttaccggggtaacccggtaacggggttacggggtaacggtaaccggttaacccggtaaaacccgggtaaccgttacggggttacgggtaccgttaccggtacccgtaacccgttaaccgtttaccgtttacggtttaccctttaccgttaaccccg

SEQ ID NO: 263126 - DNA, 740 bp, Homo sapiens
  misc_feature: GYAE6OF02IV4S0.8.33.C11.1.454.CMB.1.raw
  modified_base (213)..(213): a, c, t, g, unknown or other
  misc_feature (213)..(213): n is a, c, g, or t
  modified_base (337)..(337): a, c, t, g, unknown or other
  misc_feature (337)..(337): n is a, c, g, or t
  modified_base (409)..(409): a, c, t, g, unknown or other
  misc_feature (409)..(409): n is a, c, g, or t
tcagctcgcgtgtccacgaccggtgctcgatttagagtgagctcggttgggtttggggacggaactgctcacggtttaggacccagagggaaccatggaagccccagctcagcttctcttcctcctgctactctggctccagtttcagactaccaccggagacgattgtcgttcgacactaatctcagccacctgtctcgtctccgagggaancgccaccctctcctgcgaggccagtcagaatcggttggcgcctacggtactcctcggtaccaaactacgaaacctggaccacggcctccccgacggccccctacaactccgttagtcgggtacnccgtacgttacccgaaacgacggggcccctaacggtcgggacctaactccccaggacccctagggttacccnggtaggccgtaaggggttcggggtagttcggggaactaggtaccttacacctctaccaacctattaccattccgacgtaccgttagggacgtccgtagggtaacggtacgtttggttacgtacgttaaggttttaactttagttacgttaactaaccgtagttacccgtaaccgggtacggtcggggtaccccgggttacccgggggaccctttaccggtttcccgggacccggtacgggtaacccgtaagggttaccgagttaactaccggaaacgttacgtaggttccgacgttgaccgacctacgttcgtaccgttcttaccgtaccg

SEQ ID NO: 263127 - DNA, 803 bp, Homo sapiens
  misc_feature: GYAE6OF02HD71F.8.33.C11.1.454.CMB.1.raw
tcagctcgcgtgtccacgaccggtgctcgatttagagtgagctcgttggggtttgggggaggaactgctcagttaggacccagagggaaccatggaagcctcagctcagcttctcttcctcctgctactctggctcccagtttcagactaccaccggagagattgtgttgacacagtcctccagcccaccctgtctttgtcctccgaaggggaaagacgcccaccctctcctgcgacggccagtcagatggtgcgtcttcgaagtctacggtaaccaacaacctaaaccgtcggaccacggtcctaccccgaccggcccctacacgttcctagtcggtcgacaacctaccgaacggccgggacctacgtcggaccaccgtcccgacgtccgtacggttcaggtcggacgtaggttgggtacgtcggaacgtacgttaccttcaccgtacctaccgaacctacgtaccaacgtccgacggtccggtcgggaccgtaccgttaaaggaacgttagttcgggtttactacggttttaaacgttttacgttaccgttacgttaaaccctaaaggttaccgttacccgggttaaccgggtacggttacccggggtacccccggggttcccggggttaaccccgtttaaccggttttaccccgggggaccccttaaacggggggtaccccgtaaagggggttaccggaacggtttaacccgaaacccggtaaaaccgggccgtttacggggaccggttaccgtaacgaccccgtttactacgtttaccggttacgttacccgtttaccg

SEQ ID NO: 263128 - DNA, 756 bp, Homo sapiens
  misc_feature: GYAE6OF02G3X4N.8.33.C11.1.454.CMB.1.raw
tcagctcgcgtgtccacgaccggtgctcgatttagagtgagctcgtgggagaggagcccagcactagaagtcgggcggttgtttccattcggtgatcagcactgaacacagagactcaccagtggtaggtttgggctgaacgttcgggtttttcctcgttgcttacttttaagaggtgtccagttgtacaagtgacaacgtggtggagtcgtgggggagcgtacgtccagtccgtgggagtcacgagacgtactctccgtgtcgcgacgcccgttcgttcgggttcctaccgttcgaggttacgaccgtacggcacgtcgactacggtcgggtaccccgaaccctaaaccgtccgaggacgtaaaggggtagttcgggtagggtcgggtggtaccgttaaggttttcgtttacacgttccgtagggtacgggtacttaggttcgttagtaacggttggttagtcgtacgttcggaccggtaccggtagggacgggtacctacttaccaccgtatcccgacgaagacgaactaccgaaccgaagtaaacctagtaattggttaacgtttcggaaccgtagtaccgacgtacctagtaccgtaggacggtaaccgtacgtagttaacctacgttaacgtcggtaaacgggacggggaacgggtaacggacgggttaaccgggaacgttaaccggaccggtttaccgttacggtttacggtaccggtccgggttacgggacccgttacgggttacccgg

SEQ ID NO: 263129 - DNA, 648 bp, Homo sapiens
  misc_feature: GYAE6OF02GS2JP.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgttggcnccttcgagctgtaccacacaacngccaggctccacgcccctnatctatggtgcatcccaagacgggccacgtcggcacgtcccagccgtaggttcaggtcggcaggtgggtagtcggggacaggtacttacacgttcctacaccctataccatcgacgtccgtggacgcccgtaagaacgtacgttgttacgacgttaagttttacttacgttgttaaccaactacgttaccggtacggtacggttccgggtaccggtcccgggggtacccttaccggtttcccgggcccggttacgggaacccggtagggttacggaacgtacgtaaccggaaaaccgttaccgtagggtacggtaccgttacggaccgtaccgtagttcccgttacgttccgttactcccg

SEQ ID NO: 263130 - DNA, 848 bp, Homo sapiens
  misc_feature: GYAE6OF02JN70T.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctaccgaggggaaagacgcccaccctctcctgcagggccagtcagatgtggcgccttgagctaggtaccaacacaacgtggccaggcctacccgacggtccccctgatcctagtcgggtcgcctaacgtcccgaacggtacggggcccctaaccggtgggaccctaacgtccccccgaaggtaccccgttaacgggtttccaacggggttcgggacccgtaagggggtttacgggggttaacgttccggggggaaaccctaacgggttaacccgtttccaaacccgtttcccggtacccaacccgttaacttcgtaaacgttcccgaaccggttaccccggtaggggtaacccgtcccgttaacgggtaaaggtacggtttggttttacgaaccggttttaagtttttaacgtttaacccgtcgttaaacccgttaaacgtaccggttaccgggtttaaccgaacggggttccggaccccggggtttcccgggggaaccctttaacccggtttcccgggtcccggtaacggggtaaccgtaacggggttacggaccggttaacgtaccgtaaaacccgggtacgtcgggtacggtaccgtacgtcccggtaaacccgttgttcccggttacgttaccgttacccgttacccg

SEQ ID NO: 263131 - DNA, 677 bp, Homo sapiens
  misc_feature: GYAE6OF02JN05P.8.33.C11.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (653)..(653): a, c, t, g, unknown or other
  misc_feature (653)..(653): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaancgccacctctcctgcagggccagtcagaatgttggcgcttgtanctacggtaccaacacaacgtgccaggctcccaggcccctnactctagtggtcncactaccaacgtacgggccaacgtcggacctactcccgagtcccgtaaggttcgtacggtcggaccgtaggttgggttacgagggaaccgagtaccttcgaaccttcctcgaaccctgtacctaagtccgacgtccgtaggacgtaaccgtagaaagtagttcgtacggtacttaacgtttactttacgttacgtacccaaacgtccttaaccggtaccggtacgggttccggtacccgggtacccggggtaccttaccggtttcccgggaacccgttacgggaaccgtaacgggtcgagtaccgtaacgaaacggttacggtgtaccggactacgacccttacgngtttaccgtcgttactaccgtccg

SEQ ID NO: 263132 - DNA, 704 bp, Homo sapiens
  misc_feature: GYAE6OF02IH4UC.8.33.C11.1.454.CMB.1.raw
  modified_base (325)..(325): a, c, t, g, unknown or other
  misc_feature (325)..(325): n is a, c, g, or t
  modified_base (468)..(468): a, c, t, g, unknown or other
  misc_feature (468)..(468): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccctagtttcagataccaccggagagattgtgttgacacagtctccagccacccttgtctttgtctaccgaggggaaagcgcccaccctctcctgcgacgggccagtcagagttcgttacccaccctagttacgcctggtaaccaaccaaccaaaaccgtcggaccgacggcctacccgacggccccctanacttcgtttagatcgactactccgacgttccgacgggtacccagtcggactaacctcccgacgcccgtaggtttcaggtcggacgtaggttcgggtacgtacgggacacgttcttaccacttcacctaacgtctacacgaccncgtacctaggcgtacgttagaagtttcgtttagcctttaagttttactacgttataccgtaaacgtcgttaccggtaaccggtcggtcggtaccccggggttcccgggtaccgttcccggtttccggacccggttaacggtaaaccgtaaaacgtcggaacgtactaaccggtaaacgcggttacggcggtaactcgtacacctagttaccgtacgttcttacccgcctttccccg

SEQ ID NO: 263133 - DNA, 611 bp, Homo sapiens
  misc_feature: GYAE6OF02I9EF7.8.33.C11.1.454.CMB.1.raw
  modified_base (289)..(289): a, c, t, g, unknown or other
  misc_feature (289)..(289): n is a, c, g, or t
  modified_base (544)..(544): a, c, t, g, unknown or other
  misc_feature (544)..(544): n is a, c, g, or t
  modified_base (609)..(609): a, c, t, g, unknown or other
  misc_feature (609)..(609): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgttcatctgagggcagtgttcaatggtatggctgacgccgtgaacgggccgattcaccatctccagagacaactccaggaacacaatgtattggacctgaacagacctaagtcctgaggacacgggtntactactactgtacggaagggagggggaaccaggcggtagttccaagtaccttccgttgacgtcgtgggccagggtaccctggtcaccgtctcctcacgccctaccaccgaacggccctagtccggtcccttccccgtggccgtccccgtgcctaccgacggtacgacccaccgtccgaacgcgaccacgacggcccggaccgtcgggcctcgaccggttcggttaccgaacggtaccttaccgttccggaaccnccgtcgacgcgtacgggacgggtccgggacctcgggacgaacgggtccgacgtacgtagcgagcncg

SEQ ID NO: 263134 - DNA, 637 bp, Homo sapiens
  misc_feature: GYAE6OF02HSAKC.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttacgtaagctaggtaccaaacacaaacctggccaggcctcccaggccccctcatctatggtgcactccaacgagggcccacgtggccactcccagcctaggttcaggtggcaggtgggtaagtgggaacagtaccttcgaacctctacgtaaccatcctatccacgtcctgggacgcctaggaagtagtgttagacttaagtttaacttacgtacttacaacgtactaccggtaccgtaggtccgggtcccggttccgggggacccttaccggtttcccgggcccgtagggaacccgtaggggtagtacgaacgtaaccggaaacgtaccggtaggtccggtacgttacgaccgtaacctagttccgtcgttaccttacctaccg

SEQ ID NO: 263135 - DNA, 565 bp, Homo sapiens
  misc_feature: GYAE6OF02FMU1N.8.33.C11.1.454.CMB.1.raw
  modified_base (298)..(298): a, c, t, g, unknown or other
  misc_feature (298)..(298): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctnatctatggtgcatccaacacgggccactggcatcccagccaggttcagtggcaggtgggtatggggacagtacttcactctacaccatcatcagcctggacgcctgaagatgtgactagtttattactgtacaactactcgtaccgtagtcggtcccgtccgggggtcctacgtttccgggcccgtacgggaccgtaagggtcggagacgtacgaaacgacgtacggtacggtcgtagccaccgtactcgtacgttccttactaccg

SEQ ID NO: 263136 - DNA, 855 bp, Homo sapiens
  misc_feature: GYAE6OF02F4CH4.8.33.C11.1.454.CMB.1.raw
  modified_base (317)..(317): a, c, t, g, unknown or other
  misc_feature (317)..(317): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgccgagggccagtcagaatggttcggccgtccttacgtaagctggtaacccaaacaccaaaccgtggccaggcctccccgaacggccccctanactcctagtcgggtcgcaacgtacccaacgcggggacccacgtcggcctactccccgaggtccccgtaaggtttcaaggtcggacctaggggttacgggtagtacggggaacctaacggtactttaccaaccgttccgtacccaaccctaagtttacccgaacttaccgaacggtcccgttacgggtaaccgtacccggttaagggtaaacggttagtttcgggtttaacggtaccgtttaaaggtttttaaacgtttaaccgtttacggttaaaccctaaaccgttaccgtttacccgggttaaacccggtacgggttacccggggtaccccgggtttaccccggggggtaccccgtttacccgggttttacccggggacccccggttaacgggggtaacccgtaaacgggggttacgggtaacggtaacgttaacccggtaaaaccggtaaaccggtttcgggttaaccgggtacccgttaaccggtaccgttaacccgtacgtttccggttaccgttttccgtacccttaacccg

SEQ ID NO: 263137 - DNA, 592 bp, Homo sapiens
  misc_feature: GYAE6OF02HFX5X.8.33.C11.1.454.CMB.1.raw
  modified_base (211)..(211): a, c, t, g, unknown or other
  misc_feature (211)..(211): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (574)..(574): a, c, t, g, unknown or other
  misc_feature (574)..(574): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtctccagccaccctgtctttgtctccgaggggaaangccaccctctcctgcaggaccagtcagaatgttggctccttcgtaagctggtaccaacacaaactggccaggctcccaggccccnatctatggncatccaacgacgggccacgtggcatccccagccctaggtcaggtggctaggtgggtatggggacagtaccttcnctcacaccatcatcagcctggactccgtagaagtacgttggttacgacgttagttttaattacgttgtacctaactattaccggtacgtaggtccgggcccggttcccggggtccttaccggtttccgggcccggtacgggaccgtaggggtcgacgtaagtaccgaaacggtacgtggtacgcgtcgacctacnctcgtacgttctactccg

SEQ ID NO: 263138 - DNA, 870 bp, Homo sapiens
  misc_feature: GYAE6OF02J3HX9.8.33.C11.1.454.CMB.1.raw
  modified_base (535)..(535): a, c, t, g, unknown or other
  misc_feature (535)..(535): n is a, c, g, or t
tcagctcgcgtgtccacgaccggtgctcgatttagagtgagctcgttggggtttgggggaggaactgctcagttaggacccagagggaaccatggaagccccagctcagcttctctcctcctgctacgtctggcctccctagtttcagactaccgaccggagagtattgttagttcgaaccacgtacgttcctaccgacggtccctacccgttggttcctttacggtccgttaccgggaacggggggaaaactccggacccctaccccttccgtccgtacggcccggtacgggacccaacggttaccaaagggtacgttcggtttcgggacccgttccggtttaccggtaaacggtccgttaaccgggaaccccaaaacctaaccccgaaaccggtcggaccggaaccggtcccctaacccccggtaaccggtccccttaccacgtttaccgtaggtcggtccgaccttaccgaaccaacgggtccggcctacggcgacctacgacccgacgtaccggtaccgtcgacggtcggngttacgggggtacgtacggtcggaccctacgttaccttaccgccttaacccgtaactaccccttaacggtaacaacccgtacgtaccgtacgtactaccgtacggtaccgtttacgtttacgttacgtttagtttaccttcgtacgtacgtacgtactacgtttacgacgtaacggtccgtttacggtacccgtttaccggttacgggtaccgggtaaccgggtaacggtaacccggacgtaccgtaaccgttaacgacggttacggttcgggtctaccggtacgtccgaccgttcggttccttaacgttcctacccgttacgttccccgtccgg

SEQ ID NO: 263139 - DNA, 751 bp, Homo sapiens
  misc_feature: GYAE6OF02HPW9G.8.33.C11.1.454.CMB.1.raw
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaaanagccaccctctcctgcagggccagtcagaatgtgcgtcttgagctgtaccaacacaactgaccagcctccgacgcccctnatctatggngacactccaacgcgggacctacgtggaccactcccgacgtccgtagggttcaggtcggacgtagggttagggtacggtacgggaactacggtaaccttctaaccttccgtaccacctattaccaacttcgaaccggtcccgtagggaccgtacccgttaaggaaacggtagtttcggttacggtaacctttaacggtttttaacgtttaccgttacggtttaacctaaaccgttaccgtttacccgggttaaccgggtaacggggtttccgggtaccccggggtttccccggggggtaccctttacccgggttttacccgggacccgggttacgggaaacccgttaagggggtcggaacgttacgtaaaccggtaaaaccgggtccgttagggtccggtaccgtacggaccctaaccggttacgttaccgttcggtttacctccgttaacccg

SEQ ID NO: 263140 - DNA, 682 bp, Homo sapiens
  misc_feature: GYAE6OF02GS7MX.8.33.C11.1.454.CMB.1.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaangccaccctctcctgcagggccagtcagatgttgcgcttgaagctgaccaacacaacctggccacggctcccacggccccctanactcctatgggtgaccatcccaacgacgggccacgtggcactcccagccgtaggtcaggtgcaggtgggtanacgggacagacttcactctaccacatcatcacgccgtaggacgtccgtagacgtagtttcggttagcgttaaggttttaacttaccgttacgttacctaaaccgtacgttacccgttaaccgggtacgggttccgggtacccccgggtacccggggggttaccctttacccgggtttaccgggtaccccggtacgggggtaacccgtaacggggttacgggtacgtaacggtaacccggtaaaacggtaaccgttcgggtaacggtccgttaggaccctaccgtaacgttccgtttacggtttaccttaccgttacccg

SEQ ID NO: 263141 - DNA, 626 bp, Homo sapiens
  misc_feature: GYAE6OF02GSDXP.8.33.C11.1.454.CMB.1.raw
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
  modified_base (370)..(370): a, c, t, g, unknown or other
  misc_feature (370)..(370): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccacctctcctgcagggccagtcagaatgttgcgccttgaagctggtaccaacacaaacctggaccaggcctcccaggccccctnatctagtggtgcatccaacgagggccactggcactcccagccaggttcagtggcaggtggtatgggacagacttnactctacaccatcatcacgtcctggactccgtagaaagtattgttagcttaagttttacttaccgttagtaccaacgtacttaccggtaaccgaggttcgggaccccgtccgggggtacccttaacggttttcccgggacccgttgggaaaccgtaggggtacggacgtaccgtaaccggaaacggtacgttacgggtacggtaccgttacggacccgtaacgtacgttacccgttcgtttacccgttctaacccg

SEQ ID NO: 263142 - DNA, 647 bp, Homo sapiens
  misc_feature: GYAE6OF02HI6RC.8.33.C11.1.454.CMB.1.raw
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatcctccagagacaactccaggaacacaatgtattggactgaacngcctagtcctgagacgacggtntatactactgtacgaaggacggggaacaggcgggagttcaagttactcgtttagacgtcgtggggacctacgggtaccctggtccaccgtctccgtcgacgtccctacccgaaccgaaccgggcccaacgttcccggttcccgtttcccccgtcggcccgtaccccgtcgtcccgtccgacggtaaccgccctacccgtacccggacggacgccgaaccgacggacccggccccgtcggggtccgtccgtcccggtacggttaccgaacggttaacccgttaccgttacccgaccgtaccgcggacgtcggtacggtcggccgggtccgtacgggagaccgggccgtacagtacgnangacg

SEQ ID NO: 263143 - DNA, 744 bp, Homo sapiens
  misc_feature: GYAE6OF02HS4OJ.8.33.C11.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgctcgagggaangccacctctcctgcagggccagtcagaatgttggctccttagagctgtaccaacacaactggcaggctccgacgcccctcactctatcggtnccgtactccaacgtcgggccacgtcggctacgtacccgagacccgtaggttcaggtcggcgaggtgggtaagtgggacacgtacgttacacgttctaccgactactaccgaacttccgaaccggtccgttacggggtaccgtacccgtaggtaaaagtcggttccggtttacggtacgttttaacgttttaacgtttacccgttcggttaacctaaaccgttagtttacccgggtaaccggtaacggggttacccggtccccggggttacccgggggtacccgtttaacccgggttttcccgggcccccgggttaaggggtaacccggttaacgggggttccggaacgggttaacctaaccgggtaaaccggtaaccgttcgggtccgggtaaccgtccggtaaccgtaccggtaacgttccggttacggttccttacgtaccccgg

SEQ ID NO: 263144 - DNA, 810 bp, Homo sapiens
  misc_feature: GYAE6OF02F5PDB.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgcccaccctctcctgcgacgggccagtcagaatggttcggcgtccttcgtaagcgtacggtaacccaacaaccaaaccgtcggaccgacggcctccccgacggccccctacgtactacttagtacgggtcgactactacccgaaacgacgggccctacgtcggaccaccgtacccgacggacccgttacggttcgaaggtcggacgtacggggttagggttaggtacggggaacgtacggtaccgttacaaccgttcctaccgaacctacgtactactacacggtccgtaggtacgcgtacggtaaatacggtttggtacgtacgtttaacgttttaacgttacgtttacgtaaccgtaacgtttacgtacccggttaaccggttacgggtaccggggttccccgggttacccggggtacccgtttaccgggtttccccgggaacccggttaacggggtaaccccggtaaaggggtaccgggtaacgtaacgtaaacccggtaaaaccggtaaccggttacggttaacgggtaccgtaacggtaacccgtaccggttacctttaccggttaccgtttacccgttaccgtttacccccg

SEQ ID NO: 263145 - DNA, 612 bp, Homo sapiens
  misc_feature: GYAE6OF02GUO87.8.33.C11.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggccccctnatctatggtgcatccaacgacgggccacgtggcactcccagccaggttcagtgcaggtgggtatgggacagacttcactctccaccatcatcacgtcctgggacgccgtaggaagtattggttcgacgttaagttttattacgttagtaccaaactagttaccggtaccggaggtcgggtcccggtcccgggggtacccttacccggtttcccgggcccgttacgggaacccgtaggggtacggagtacgtaccggaaaacggtaacgttcggtacggtcgtcggaccaccgtacttcgttcgttccttctaccg

SEQ ID NO: 263146 - DNA, 899 bp, Homo sapiens
  misc_feature: GYAE6OF02HF5JL.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaancgccacctctcctgcgacgggcctagtcaagtaactggttcggcgtcctttacgaagcttaggtaaccaaacaacaaaaccgtcggaccaacgggcctaccccgacggtccccctacgaacttcgtaagtcgggtacgcactacccgaaacggcgggacctaacgttcggaccaaccgtccccgaacggtcccgtaagggttccgaacgggtcggaccgtaggggttacggggttaacggtacgggggtaacgtacggttaacctttacccgaacccgttcccttaacccggtaaccctaacgtttaccgtaaaccttccgggtaaccggtccccggttaaggggtacccgtaaccccggttaagggtaaaaccggtttagttcggggtttaccggtaaccgttttaaacgggtttttaactttaaccgttacggttaaaccgttaaaacgttccgtttaacccgggttaaaccgggtacgggttacccggggttaacccccgggttcccggggggtaaccctttacccggggttttcccgggtaaaccccggggttaccgggaaaccggtaacgggggtacggtaacggttaaccggttaaccgtaaaacccgggtacgttacggggcggttaaccgaggtaacccgtacgtaacgtttcccgttacggtttccctttaaccgtaccccg

SEQ ID NO: 263147 - DNA, 915 bp, Homo sapiens
  misc_feature: GYAE6OF02HOJDE.8.33.C11.1.454.CMB.1.raw
tcagctcgcgtgtccacgaccggtgctcgatttagagtgagctcgttgggtctgggagaggagcccagcactagaagtcggcggtgtttccattcagtgatcagcactgaacacagaggactcaccatggagtttgggctgaactgggttttcctcgttgctctttaagaggtgtccagtgtcaagtgacaacgtggtggagtcggtgggggaggcggtagtccagccgtggggaacggtcacaggacgactctcctagtgcgagtcccttcgtcgggttcctacccgtttcgaacggttacgcgttacggacctagttacgcgaacgtcggggtaccccggacccaaaaccgtccgaacgggacgaacggggtatttacggggaacgggttgggggtaggtaccgttaagggttttgttttaccgaactttccggtaagggacgggggtaccgtaagggttacggttttaaccgaaaagtttggggtttaacgtcggggtaccgttagggttaacccggaccgggttacgggaacgggggtacccgttaaacgtttacccaacccgttaaccgtacccgtacccggaaacggtaacgtaaacccgtaaaccgtacccggaaacggtaaaaccgaaacccgttaaagttaacggtttacgtttaccggtaaccgttaacgaaaaccgtacgttaaaccgtaaaccgggtcccgtaagggtaaccgggaaccgtaagggttacgttaaacgttaacccgttaggttacggtaaaaccggggtaaacggggggaaccggggggtaaaacccggtaacggggtaacccggggttaccggtttaaaccggtaaacccgggttttaccggttaacccggtttttacgggtaaccggggtttccgggttaacccggggggg

SEQ ID NO: 263148 - DNA, 688 bp, Homo sapiens
  misc_feature: GYAE6OF02JI1TS.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttaggacccagagggaaccatggaagcccagctcagcttctcttcctcctgctactctggctcccagtttcagataccaccggagagattgtgttgacacagtctccacgccaccctgtctttgtctccgagggaaanacgccaccctctcctgcgacgggccagtcagaatggttcggcgtccttacgtaagctacggtaaccaaacaacctaaacgtcggaccgacggcctccccgacggcccctctactccttagtcggtcgcaactccgaaacgcgggaccacgtcggcaactcccgacgccgtacggttacaggtcggactacgggttgggtagtacgggactaacggtaccgttacacgttcctaccacctaactactacactacggtccgttacgggacgtaccgtagaacgtagttcgtagtcgttaagtttacttaacgtcgtaacctaacgtacgtacgttaccgaggttcccgggccggtacccgggtaccttacggtttacccgggccggttacggaacccgtagggttacgacgttaacgtaccgaaaccggtagtacgggtacggccgtacgacctacgtaccgttcgtcgttactcgtaccg

SEQ ID NO: 263149 - DNA, 754 bp, Homo sapiens
  misc_feature: GYAE6OF02JXZQU.8.33.C11.1.454.CMB.1.raw
  modified_base (185)..(185): a, c, t, g, unknown or other
  misc_feature (185)..(185): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (615)..(615): a, c, t, g, unknown or other
  misc_feature (615)..(615): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggacttggagtggggtgcagttggtttcatctaggagggcaggtnttcaatggtatgctagacgcgtgaacggcattcacctatccgtcagacgacacgtcgacggaanacaatgtatttcggactagaacncgtacctaacgtcctgaacgtacgtaggggtctactacgtactgtacggaagggaacgggggtacaaggtccgggactacggaagtacctaccgttaggacgtcgttacggggaccgtacgggtacccgtcggtaccttacccgggtcttacccgtacgtaccgtaccgttccccgaaccgaaccgggggtcccctaccgttacccgggttacccctttccccccggtcggggtaacccccgtcccggtaccggtaaccccctcggtaaccggttaccggaccccggtacccgtacccgggtaacgtcggaacccggacccgaacgccccggggttaacccgnggggtaccctacgggtccccggttacggtcgaaaaccgtttccgaccgttacccggtaccctaccggacccggtagtccggtacgaacggggccggtccgtacgggaccgacgggtccacggtaagtcgagcgtgaacg

SEQ ID NO: 263150 - DNA, 929 bp, Homo sapiens
  misc_feature: GYAE6OF02FGUWU.8.33.C11.1.454.CMB.1.raw
  modified_base (212)..(212): a, c, t, g, unknown or other
  misc_feature (212)..(212): n is a, c, g, or t
tcagctcgcgtgtccacgaccggtgctcgatttagagtgagctcgttgggtttgggggaggaactgctcagttaggacccagagggaaccatggaagccccagctcagcttctcttcctctgctactctggctccctagtttcagataccaccggagagtattgtgttgacacagtctcagccacctgtctttagccttaccgagggaaacncgcctaccctactccgtgaccgtacgggccaaggtccaggtaagtcgttacggaccgtccgtttacggtaagccggttacggttaacccaaacgtaaaccgtaaaccggttacggacccgtaacggtccctacccgacgggttacccctcgtaactaccgtacgttacgggtcgacctaacgtacccgtaaccgtacggggacctaacgtcggacctaacgttaccccgaggtacccgtaacggttaccgtacggtggaaccggttacgggttacgggtaacgttacggggacctaacgggttaccttacggtaacccttcgtaacccgtaccgttacgtacccgtacgtaccggttacgaccgttacgggtaaccgtaccttaagggtaaaccgttacgtttagggtaccgtaaccgttttaacggtttacgtaacccggtttacggtaaccttaaaccggtttaccgttacccgggttaaacggtacgggtttacccgggaaccggttttaccccgggggtaccctttaacccgggtttaccgggacccccggtttaacgggtaaacccggttaacggggttaccgggttaacggtaaccgttaaacccggtaaaccggtaccggtttaccggttaccgggtaacccgttacggtaaccccgttaaccggttaacgttccccggtttacgtttaccccgttacgttaaaccccgg

SEQ ID NO: 263151 - DNA, 640 bp, Homo sapiens
  misc_feature: GYAE6OF02G68TH.8.33.C11.1.454.CMB.1.raw
  modified_base (179)..(179): a, c, t, g, unknown or other
  misc_feature (179)..(179): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
  modified_base (459)..(459): a, c, t, g, unknown or other
  misc_feature (459)..(459): n is a, c, g, or t
  modified_base (511)..(511): a, c, t, g, unknown or other
  misc_feature (511)..(511): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctcttttaaggnggtgtccagtgtcaagtgcaacgtgggtggagttcgtggggggaggcggtagtccagccgtgggagtcacagacgacttctccgtgtgccagcctcgtgggttccaccttcagtcgcctacggcatgctacgtcgggtcccgaccaaaccgtccgaaggacgaacggggtnttggggacggttggggtgacgttaggtttgttcagttcgtaggacgggtctaggttntaacgtagtcggtatcgtacgtcgaccggtcgtaggacggccgtatccactntctacagacgacgacctacgagaacacaattgtagttacgacctagaacganaccgttacgtcgtacggaggtccgtacggtagtacgtaccgttagaggtaccgggaagggaccgggaacgacgggacggttacgtaccgaacggttaccgttccggttaacggtccggtacggtccggg

SEQ ID NO: 263152 - DNA, 719 bp, Homo sapiens
  misc_feature: GYAE6OF02F4TRF.8.33.C11.1.454.CMB.1.raw
  modified_base (211)..(211): a, c, t, g, unknown or other
  misc_feature (211)..(211): n is a, c, g, or t
  modified_base (318)..(318): a, c, t, g, unknown or other
  misc_feature (318)..(318): n is a, c, g, or t
  modified_base (488)..(488): a, c, t, g, unknown or other
  misc_feature (488)..(488): n is a, c, g, or t
  modified_base (683)..(683): a, c, t, g, unknown or other
  misc_feature (683)..(683): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgttgacacagtctccagccaccctgtctttgtctccgaggggtaacgngccacccgtctcctgcgagggccagtcagaatgtcgacgtccttagtaagcgtaggtaccaacacaaacgtcggacacggctcccgaggccctcactctatgggtcnccatacccaacgagggtacccacgtcgggacctaacctcccgacggtccgtaacgggttccgaaggtcggcctaagggttcgggtagtacgggacacgtaacgttcacgtttccacgacctatccgacttaccgagtcctaggaccgtcgtacgaaagtcgttggtaacncgttaaggttttacttcgttaacgggtaccctaaagttacgttacggtaacccggtggttaccggacccgggttacccgggtccgtttaaccggttcccgggtaacccggtacggggttaacccaaggggttccggaacgttaacccgtaacgggaaaccggttacgttaacggggtcgtacccgtacggtaccncggttaaactcccgttgttaccgttacgttaccccg

SEQ ID NO: 263153 - DNA, 621 bp, Homo sapiens
  misc_feature: GYAE6OF02IM0RH.8.33.C11.1.454.CMB.1.raw
  modified_base (212)..(212): a, c, t, g, unknown or other
  misc_feature (212)..(212): n is a, c, g, or t
  modified_base (313)..(313): a, c, t, g, unknown or other
  misc_feature (313)..(313): n is a, c, g, or t
  modified_base (454)..(454): a, c, t, g, unknown or other
  misc_feature (454)..(454): n is a, c, g, or t
  modified_base (613)..(613): a, c, t, g, unknown or other
  misc_feature (613)..(613): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagatacccaccggagagattgtgttgacacagtctccagccaccctgtctttgtctccgaggggaaanacgcccaccctctcctgcacgggccagtcagaatgttgacgtccttgaagctaggtaccaacacaaaccgtcggccaggcctaccccgacggtccccctanactcctagttcgggtcgctactacccaaacgacggggccacgtgggcctactcccgacgacctacgggttacaggtcggacgaggttaggggtacgtgggaacacggtacttacgactcctaccgacctaatcaatcgacncccgtgggaacctcgtagaagtcgttggtcgtacgttagtttaactcgtacgtacaactacgtccgtacgcggtcggtccggtccgggtcctcggttccggccgtaggaccgtaggtcgagactaacgaacgtacgtgtcgtcacgacacctagtcgtntcctatcg

SEQ ID NO: 263154 - DNA, 588 bp, Homo sapiens
  misc_feature: GYAE6OF02HB5K8.8.33.C11.1.454.CMB.1.raw
  modified_base (209)..(209): a, c, t, g, unknown or other
  misc_feature (209)..(209): n is a, c, g, or t
tcagctcgcgtgtccacgaccggtgctcgatttagagtgagctcgttgggtttgggggaggaactgctcagttagggcccagagggaaccatggaagccccagctcagcttctcttcctcctgctactctggctcccagtttcagataccaccggagagattgtgttgacacagtctccagccaccctgtctttgtctccaggggaaanagcccaccctctcctgcagggccagtcagaatgttggcgccttcgtaagctggtaccaacacaaaccgtggccaggcctccccgaggccccctcatctatggtgcactccaacgacgggcccacgtcggccactccccgagcctaaggttccaggtcggcgtaaggtgggtaagtggggacagtacttcacttctaccacctatcactcgacgtccgtaggacgtccgtagaagtatggttcgacttagtttacttacgtcgtacaactagtccgtaacgtgtcggccggtccgggtcctacgttccggacgtcggacgtaggtgagacgtacgaacgtacgtgtacgcgtagaccactagtcttcgttccttataccg

SEQ ID NO: 263155 - DNA, 649 bp, Homo sapiens
  misc_feature: GYAE6OF02I1LJG.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaagacgccaccctctcctgcaggccagcagaatgttgcgtccttcgtagctggtaccaacacaaccgtggccacggcctcccacggccccctacactctagtggtcgctactaccaacgacgggccacgtggcactcccacgccgaggttcgagtcggacgaggtgggtagtcgggacacgtacttcgactctacaacctatactacgtacacgtaccgtgggactcgtaggaagtagttcggttagacttagtttacttacgttagtacctaactacgtaccggtacggtacggtccgggtcccggttacccggggccttaccggtttcccggtccggtacgggtaaccgtaacgggttcggacggtacgtaacggaaccgtaacgttcggtcggtacctacggacctaccgtaacgttccgttacgtttccgttactacccg

SEQ ID NO: 263156 - DNA, 791 bp, Homo sapiens
  misc_feature: GYAE6OF02H9AO9.8.33.C11.1.454.CMB.1.raw
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttggctgaactgggtttcctcgttgctntttaagnggtgtccagtgtcgaagtgacacgtggtggagtcggtgggggagcgttagtccaggccgtaggggacgtacacgagaacgtcctctccgtgtcggcacgtcccttcgttcgggttccctaccgtttcaggtaccgtcgtaaccggtctagttccgaccgtacggttaccgggtccccgaaccctaaaacccgtcccggaaggtaccgaaggggttgttacgggggtaaggttggggtcgtcgttaaggttttcggttacgtactccggtagggtaacggggtccgtaggttcgtttaacgaagtttgggtacgtcgtacgtgggtacccggtcgggtaacggggaacggttcccgttaacgttcccgtaaccgtacgtcccgtacgtaacgggaacctaacccggtacctaccggaaacggaacccgtaagtaacgttaggtttacgttaccggaccttagtaaccgtacgtaaccgtttaaccgcgtaaggacgtacggacggtattacctacgttacggtaaggtacggggaaacggggtacggtaccggacggtaaccgggtagttaaccggtacgttaccgtttacggtcggttacggttacgggtaccggg

SEQ ID NO: 263157 - DNA, 629 bp, Homo sapiens
  misc_feature: GYAE6OF02F1MWG.8.33.C11.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangccaccctctcctgcagggccagtcagaatgttgcnccttgaagctggtaccaacacaacctgccaggcctccgaggcccctnactctatggtgacataccaacgacgggccacgtcggacactcccgagcccgtaggttcaggtggcgaggtgggtatcggggacaggtacttcactctacaccactcatcacgctggactccgtagaagtattgtacgcgttagttttaattacgtgttaaccaatacgttaccggtaacgtaggtccgggtacccggtcccgggggtaccttaccggtttccggacccggttacggggaacctaaggggttcggacgtaacgttaccggaaaacgtaccggttacggtacggtaccttaggacctaccgttattccgttacgttccgttactacccg

SEQ ID NO: 263158 - DNA, 866 bp, Homo sapiens
  misc_feature: GYAE6OF02GK8FB.8.33.C11.1.454.CMB.1.raw
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacaatctccagccaccctgtctcgtctccgagggaancgccacctctcctgcgacggccagtcagatggttgccgctacgtactccgtcggtaaccaacgagaaaccgtcggaccacggcctccccgacggtcccctnaacttcgttacgtggtcgccactacccgaaacggtaccgggacctacgtcggacctaacctaccccgagtacccgtacggttaccggaggtacggtacgtaacgggggtttcgggttaagggttaccgggaaacgtaccggttaaccgttaccctaacggttccctaacccgtacccgtaaattacccggtaatacccggtacccgttacggtaccggggtacccgtacccggttggggtaaccggtactttcgggttaccgtaacgtttttaacgttttacgtaacccgggttttgtaaacctaaacccggtttcgggtttaacccggttaccgggtacggtttccccggggtcccccggggggttaacccgggtaaccctttcccgggggttacccgtccgggttaaacccgggaaacctttaaagggggccctttaaggttaaccctaaacccggggtaaacggtaacccgtttggggtccccggaacggtttacgaacccgtaccggtttaacctccggggtttaccgtttaccccttaccggtttaaccccg

SEQ ID NO: 263159 - DNA, 564 bp, Homo sapiens
  misc_feature: GYAE6OF02FYSL3.8.33.C11.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagctcgcgtgtccacgaccggtgctcgatttagagtgagctcgttggggtttggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgtgcncttganctgacanacaacngcagctccagcccctnatatatggtcgacatccaaacgagggccacgtcggcactcccagccaggttcaggtcgcaggtgggtatgggacagtactcactcncacntcatcacgcgtaggacgctagaagtntgtnacgtatttactactgtactaacagtccgtacgtaggtcggccggtccggggtcctacggtttccgggcccgtagggaacccgtaaggggtaggacgtacgtaaccgaaacggtaacgttggtacggtcgtacggaccaccgtactcgtcgttccttactaccg

SEQ ID NO: 263160 - DNA, 647 bp, Homo sapiens
  misc_feature: GYAE6OF02FXBIL.8.33.C11.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctcgagggaaanacgccaccctctcctgcagggccagtcagaatgttggcgtccttgtaagctaggtaccaacaacaacctggaccaggcctccacggcccctatactctancggtagctactaccaacgagggcccaacgtcggccatccccgagcctaggttcagtcgcgaggttgggactagggacagaccttcacgtctacaccatacatccacgccgtaggactccgagaagacttggtcacgttaagtttaacttacgtagtaccaactacgtcgtaaccgtacggtccgggcccgtacccggggtaccttaccggttaccggtcccggtaacggtaaccggttaacggggtacgagttaaaccgaaccggtaaacgggtaaccttacgggtaccggtaccgtacgaccctaacgttacctacgttcgtttacccgttactaacccg

SEQ ID NO: 263161 - DNA, 640 bp, Homo sapiens
  misc_feature: GYAE6OF02H3VZ3.8.33.C11.1.454.CMB.1.raw
  modified_base (242)..(242): a, c, t, g, unknown or other
  misc_feature (242)..(242): n is a, c, g, or t
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaacttgggttttcctcgttgcttctttttaagaggtgtccagtgtcaagtgctaacgtggtggagttcgtgggggagcgtagtccagcctgggngtcacagacgactctcctgtgcagcctcgtcggttcaccttcgagtgcctacggctatcgcacgtcgggtcccaccgtaaacctcgaggacaaaggggtnttagggaggttcggggtgctaggtttgtttacagtcgtggaggtctagtgttacagttgtatcgtgtcgacgtccgtaggaacggtcgtacttaccacctactctacganacgaccactaccgaagaacctaacgtattagttagttacgaccgtacgaacgacgtacctaacgttcgaggtacgacgtacggtagtacgttaacgttacgtagggtacggaacgggtaacggggacgtaagggacggtacgttaccgtaacgttaccgttaccgttacgtacggttccggtaccggg

SEQ ID NO: 263162 - DNA, 816 bp, Homo sapiens
  misc_feature: GYAE6OF02I8RKE.8.33.C11.1.454.CMB.1.raw
  modified_base (170)..(170): a, c, t, g, unknown or other
  misc_feature (170)..(170): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgctnttttaagaggtgtccagtgtcaagtgcaactggtggagtcgtgggggaggcgtagtccagccgtgggagtcacgagagacctctcctgtgcagcctcgttcgggttcctaccttcaggtacgccgtacggcagtgctacgtcgggtcccaccaaactccgaggacgaagggtacttgggacggtgggtggacttaggtttcgttacgacgttcgtagggacgggtctaggttacgtttagaaacggttggttactcggtcgttacggaccggtccggtagggtaaccggggtaccgtacgttacccaaccgtacgttaccgtaccgacggtaaaccggtaacctaaacccgtaaccgaaacgggtaaaccgtaacgtaaacggttacggtttaaccgtttacgggaaccttaacgaaaccgtaaccggtaacccgttaaacccgttccggttaacgggaaccgggtaaccgggttaaccgggttaagttaaacgttaaccgttaccggtaacgggttaaaccggggaaacgggggtaaaccggggggaaaccggtaccggggtaacgggttaaccggttaacccgtaaacgggtttaccccgtttaccggtttacgggtacccggttaccggggttaacccggggg

SEQ ID NO: 263163 - DNA, 812 bp, Homo sapiens
  misc_feature: GYAE6OF02FW52I.8.33.C11.1.454.CMB.1.raw
  modified_base (221)..(221): a, c, t, g, unknown or other
  misc_feature (221)..(221): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagactaccaccggtagagattcgtgttgacacagtcctccagcccacccgttgtccttttagcctccgaggggaaacncgccccaccctctccgtgccgacgggcccagtccaggactggttcggccgtccttcggtaacgccgttaggtaacccaaccaccaacccgtcggcccacggcctaccccgacggcccccctcacttcctattcggtcgccactccgaacgtacggccacgtcggccaactccccgacgtcccgtaggttccgacggtcggactagggtcgggtaacgtcggggaactacggtaccttaccgtaccgtccgtacccacccgtactaccaccgttaccaaccggtcccgttacgggtacccgtacccgttaacggaaacggttacgtttaccggtttaccgtacgtttaacggtttttaaccttaccggttacgttaacccgtaaaccgtaccggttacccgggttaaaccggtcgggttacccgggtaccccgggttacccgggggtacccttaacccgggttttcccgggacccgttaccgggaaccgtaacgggtacggacgtactaacccggtaaaccggtaccggtcggttaccggtccgtacggaccctaaccgtaccgttccgtaccgttaccttaccgttacccg

SEQ ID NO: 263164 - DNA, 557 bp, Homo sapiens
  misc_feature: GYAE6OF02JQAYQ.8.33.C11.1.454.CMB.1.raw
  modified_base (124)..(124): a, c, t, g, unknown or other
  misc_feature (124)..(124): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccnccaaactccaggcaagggattggagtgggtggcagttgtttcatctgagggcagtgttcaatggtatgctgacgccgtgaagggccgattcaccatctccaagagacaactccaggaacacaatgtatttggactgaacagcctaaagcctgagacacggtatatactatgtacgaaggagggggaaccgagcgggagttccaagtactcctttgacgtctgggcctagggtacctgtacnccggttacnccgtnacgccttccaccgaacggaccctagtcggtacttccccgtggccgtccctacgcttcccgaggtacgcaccgtaccgagtacgacacgacgcgtccgtcgggctcgctcgacaacggtactccgtacgacacgcgacgtgcgtaggcggtgtcggacgaaggaccgcataggacngnc

SEQ ID NO: 263165 - DNA, 775 bp, Homo sapiens
  misc_feature: GYAE6OF02I4NBP.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctccctagtttcagataccacggagagtattgtgttgacactagtctccagccacctgttctttgtcctaccgaaggggaaacgcgcccacccttctcctgcgagggccagtcagtatggttcggcgtccttcgaagcgtacggtaaccaacaactaaaccgtcggaccgacggtacctccccgaccggtccccctacgtacttacgtagttcggacgtacctaccgtaaccgaacggaccggacctacggtacgacctacccgtacccgacgtaccgtacgtacggtacggtacggtacggtagggtacggtaggtacggaacgtacgtaccgtactacgttaccacctacctacgttacgacgtacgtaccgtacggtacgtacgtaccgtagtaacgtacgttacggttacgttacgttaacgtttaacgttacgttacgtaacgtaactaccggtacgttaccggttcggtaccgggttacccggtacccggggtacccgttaccggttccggtaaaaaaacccggtcggtaaccggtaacggtacggtacgtaacgtaaccggtaacggtacggtacggtaccggtacgtaccgtaccgtacgtaccgttaccgttaccgttaccgttaccgttacccg

SEQ ID NO: 263166 - DNA, 739 bp, Homo sapiens
  misc_feature: GYAE6OF02F1GMK.8.33.C11.1.454.CMB.1.raw
  modified_base (213)..(213): a, c, t, g, unknown or other
  misc_feature (213)..(213): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattcgtgttgacacagtctccagcccaccctgtctttgtctccgaaggggaaancgcccaccctctcctgcgaggccagtcagatgtgcgtcctgtagctggtaccaanacaactggcaggctccgacggcccctnactctagtggtcgacacgtccaacgacgggcccaagtcgggactaccgtaccccgacggtacccgtaggtttccgaaggttcgggaccgtacggggtttaggggtacgtacgggggaaacctacggtacctttaccgaaccttaccgtacccgtaaccctaactcctaacttaccgacggtacccgtacggaacgtcccgtagggaaacgtagttacggttcggtacgttaagttttaacgttacgttagttaaccaaccgtaagtttaccggtaaccggtaggtccgggtacccggtacccgggggtccttaccggttttcccgggacccgttacggggtaaacccgtaggggttacgaacgtaacttaaccggaaaacggtaccgttagggtacgaccgttacgccctaacgttacgttcgttcgttaccttaggttacccg

SEQ ID NO: 263167 - DNA, 766 bp, Homo sapiens
  misc_feature: GYAE6OF02IPB1H.8.33.C11.1.454.CMB.1.raw
  modified_base (215)..(215): a, c, t, g, unknown or other
  misc_feature (215)..(215): n is a, c, g, or t
  modified_base (388)..(388): a, c, t, g, unknown or other
  misc_feature (388)..(388): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctccagtttcagataccacggagagtattgtgttagacacagtcctccagcctaccctgtctttgtctaccgaaggggaaancgaccctaccctctcctcgcgacgggcctagtcaagtaatggttcggccgtaccgttacgtaaggccgttacggtaacccaactaaccaaccgtcggaccacggcctacccccgaccggccccctcgacttacgtacgtcggtagacctactacccgaaccggacgggacccnccgtacgggacctacctaccccgacgtccgtaggttacacggtggaccgtaggttacgggtaggtcggtacgtacggttaccgtctaccgtctaccacctacttaaccgtactaccgtaccggtaccgtaggtaccgtaccgtacggtaacgttacgttcggttacggtaccgttaagttttaattaccgtttacgtaccttaacgtaccgtaccgggttacgtaccggtaccggggtcccggttacccgggtcccgttaccgggtttaccggtacccggtacggaacggttagaccgtagaaccggtaacgtaacgtaacggttcggtacggtaccgtcggaaccgtacgtacgttccgtccgtaccttccggtacc

SEQ ID NO: 263168 - DNA, 675 bp, Homo sapiens
  misc_feature: GYAE6OF02JKQ37.8.33.C11.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggcctccagtttcagatacccaccggagagattgtgttgacacagtctccagcccacctgtctttgtctccagggaanagccacctctctgcaggccagtcagatgtgcncctganctgacancaactgcagctccagccctnactctatggtnacactccaacgacggcccatcggacnctcccacgccgacggttcagttcggctagggttcgggtaatcgggaacaggtaccttcgacttcctccgaacctagcacgtccacgtcccgtaggacgtccgtaaggacgtacgttcgttacggctttaacgtttacgtttacgttacggtacctaaacgtaccgtaccggtaccggtacgggtaccgggtcccccggtaccgggggttaccctaccggtttacccgggtaccccgttacggggtaaccccgtaggggtacccgggtaggtaacggttacccgtaaaacccggtaagtttacgggaccgttaccggtacgcccgtaacccgtaccgttacgtccgtttacccgttaccgtaacccg

SEQ ID NO: 263169 - DNA, 892 bp, Homo sapiens
  misc_feature: GYAE6OF02HHDI6.8.33.C11.1.454.CMB.1.raw
  modified_base (165)..(165): a, c, t, g, unknown or other
  misc_feature (165)..(165): n is a, c, g, or t
  modified_base (485)..(485): a, c, t, g, unknown or other
  misc_feature (485)..(485): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgacttggttttcctcgttgtcttcttttaagnggtgtaccagtgtcaagtgacaacgtggtggagtcgtgggggagacgtagtccgaggccgtggggacgtcaactaggacgaccttctacccgtgtcgccgtagtcccgttcgttacgggggttacctacctttacgaaggttacgccgttaagggcctaagttcggtacctacggttacggggtacccctaccgtaaaacctcccggacggggtacgaaacggggtactttcgggaaggttggggtaccggacgttaggtttcgtttaccgagttccggtggtaggggtacctaagggttcgttacgaagttcggttaancggtacttaggaacccggttcgtaaggaaccggggtcctaacgttccgtacccgtagttaccgtaccgtaacggtaaccgtaaccgtaaaccgtcccggaaaggtaaccctaaacgttaaacgtttcggtttaaacgtttccgggaacccttaaggtaaacccggagttacccggttaaacggtacccgtttaagggaaccgggaccggttaacgggttacgtaaacggttaccgttaacgggtaacggtaacggggtaaccggggggtaaacgggggacccctaaacggggtacccggggttaaaacgtttacccggtaaaccggtttaaccggtttaccccggttttaagggaccccggtttaacggggtcccggggttaacccggttaccggggttaaccccgg

SEQ ID NO: 263170 - DNA, 632 bp, Homo sapiens
  misc_feature: GYAE6OF02G8QN0.8.33.C11.1.454.CMB.1.raw
  modified_base (309)..(309): a, c, t, g, unknown or other
  misc_feature (309)..(309): n is a, c, g, or t
  modified_base (509)..(509): a, c, t, g, unknown or other
  misc_feature (509)..(509): n is a, c, g, or t
  modified_base (601)..(601): a, c, t, g, unknown or other
  misc_feature (601)..(601): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagactaccaccggagagattgtgttgacacaatctccagccacctgtcttcgtctccgaaggggaagacgcccacctctcctgcagggccagtcagaatgtgctcttgaagctggtacaacacaaacctggccagctacccacggcccctagactctatcgggtncactccgaagacgggccacgtggacacgtcccaacgtccgtacggttacgaggtcggactacggtggttagtagggaacagtacgttcacgttactaccaaccgtactactatccgaacggtcctaggaccgtacgtaagaaagtcgttagtacgtcgttaagtttattaccgtagtaccaaatacggtacgtaaccggngtccgggcccggtacggggtccttaacggttcccggccgtacgggacgtaagggcgacgtaactaaccggaaacgtacgtcggtgtacggtnacctacgaggttctacggttcttacgtaccg

SEQ ID NO: 263171 - DNA, 722 bp, Homo sapiens
  misc_feature: GYAE6OF02I2EA6.8.33.C11.1.454.CMB.1.raw
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgtacacagtctccagcccaccctgtctttgtctccagggggaaanagccaccctctcctgcaggccacgtcagaatgttggcgccttcgaagctggtaccaacaccaaccngccacggcctcccaggcccctccatctataggtgcactccaacgacggccactggcactcccagacctggttccaggtcggtcgagttggggtactggggtaacacggtacttaccgtacttacccctcgaacccctactttaccgacttacgtaaccgtccgttaccgggacggtacccgttacggaacggtaacgttacgggtttactcgttaacgggttttttaactttaacgtttcggtttacctaaacccgttagttacgggtaccccttaagggttcccgggtacccggtccgggggttaaccccgtcggttttaccccgggtcccgttccggggtaaccggaaccgggttaccggggagacgttaacccggaaacgttaaccgtacggtacgggtgtccggtactaacccggcttccggttcgttccttacggtacc

SEQ ID NO: 263172 - DNA, 562 bp, Homo sapiens
  misc_feature: GYAE6OF02IZIRB.8.33.C11.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (500)..(500): a, c, t, g, unknown or other
  misc_feature (500)..(500): n is a, c, g, or t
  modified_base (542)..(542): a, c, t, g, unknown or other
  misc_feature (542)..(542): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaancgccacctctcctgcngggccagtcagatgtgccncttgancgtgacanacaactgcagctccagccctnacgtctagtggtacncacgtaccaacgtgggccacgtcggctactccgagcccgtaaggttcacggtcggcgtaggtaggtagtacgggacaacgtcttcgtacctntaccncgtacnctactcacgcgtgacgctagagattgtagctacgtttatactgtacactctacgtacgacgttcggcccgtcgggctacgttccggcgtacggccgtagggtnacgtacgactaacggtaactggtaacgcttaacggctaccgngttacgtcgttctactaccg

SEQ ID NO: 263173 - DNA, 644 bp, Homo sapiens
  misc_feature: GYAE6OF02JKK3B.8.33.C11.1.454.CMB.1.raw
  modified_base (324)..(324): a, c, t, g, unknown or other
  misc_feature (324)..(324): n is a, c, g, or t
  modified_base (636)..(636): a, c, t, g, unknown or other
  misc_feature (636)..(636): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaacgagccacccgtctcctgcacgggccagtcagaatgttggcgccttcgaagctggtaccacacaaacctcggccaggctcccgagcccccgtcactctatggtagcactccaacgnggaccactggcactcccagccacggttcaggtagcgtagtgggtatcggggtacaggtacttacgactcgtcctaccgactcacttcgacgcctaggacgtcctagaagagttgttacgcttagttttaacttacgttagtaccgaaatacgtaccgtaaccggtaggtccggtacccgttccggggacccttaccgtttccgggtacccgtaccggggtaaccgtaagggttacggaacgtacgtaaccgaaccgtaacgttagggtccgtacgtccgtacgtaccgtacgttccggtaagtttcccgttnttaacccg

SEQ ID NO: 263174 - DNA, 652 bp, Homo sapiens
  misc_feature: GYAE6OF02F95T9.8.33.C11.1.454.CMB.1.raw
  modified_base (211)..(211): a, c, t, g, unknown or other
  misc_feature (211)..(211): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangcccaccctctcctgcgagggccagtcagaatggttggcgtccttggtaancgtggtaccaacacaacctggccaggcctcccagcccctnactctatggtncatccaacgacgggccacgtggccactcccagccaggttcaggtggactagggtgggtagtggggactacgtacttacacctctacacctatccatacagccgtaggacgccgtagaagtattaggttcgtacgttaagttttacttacgtagttactaacgtacgtaccggtaaccggttaggtacgggtcccggtacccgggggtacccttaccggtttccgggtacccggtacgggaaaccgtaaacgttacggaacgtacgtaaccgtaaacggtaacgttacgggtcggtacgtacggaccgtacctcgtacgttaccgttaccttcgtacccg

SEQ ID NO: 263175 - DNA, 747 bp, Homo sapiens
  misc_feature: GYAE6OF02F0EEQ.8.33.C11.1.454.CMB.1.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtcctccagcccaccctgtctttgtcctccgaaggggaaagagcccaccctctcctgcagggccagtcagatgtgcncttganctgtacaacacaactgcagcnccacgccctnatctatggnctactaccaacgcggccacgtggacactacccagccgtacggttcaggtcggaccgtagggtgggtagtacggggactaacggtacttaccgactcctaccgaacctatctacgtaccgacgccggttacgggacgtcccgtaaggaaacggttcgttacggttagtacccgtttaaggtttttaccgttaccgtttagtaaaccctaacgtacgtttacccggttaaccgggtacgggttaccgggttcccccggggtacccgggggttaccccgtttaacccgggttttacccggggaccccggttaccgggggaaacccgttaacgggggttacggaaccggttaacccgtaaacggtaaaacccgggtcggtttaccgggtacgggtaccctaccgggaccctaaaccggttcgttacccgttcgtttaccttacccggttaccccg

SEQ ID NO: 263176 - DNA, 784 bp, Homo sapiens
  misc_feature: GYAE6OF02I1QA5.8.33.C11.1.454.CMB.1.raw
  modified_base (271)..(271): a, c, t, g, unknown or other
  misc_feature (271)..(271): n is a, c, g, or t
tcagctcgcgtgtccacgaccggtgctcgatttagagtgagctcgttggggtttgggggaggaactgctcagttaggacccagagggaaccatggaagccccagctcagcttctcttcctctgctactctggcctccctagtttcagactaccaccggagagtattgtgttagaacacagtcctccagccacccttgtccttcgtctccggaagggaaagcgcccacctctcctgcgagggccagtacagtagttggtcggcgcctacgtntccgtacgtaccaacaacgaaccgtcgccgacggcctacccgaccggcccctatacttacgtagtacggtcacctacgtaaccgaacggaccggtaccgtaaccggtccggtaactaccgtcccgacggtacccggtaggttaccggacggtccggacgttaggggttacgggtacggtacggggtaacgtacggtaccttaccgtaccttaccgtaaccgtacctacgttaccgtaccgttacgaaccggttccggtacgggtaaccggtccgaagggttacggtacgttcgttacggtactttaacgtttacttcggaacgttacctaaacgttcgtaccggtaacgtccggttccggtaccccgggtccgggtaccgttaccggttcccgggtaacccggtaacggtaaccggtaacggttacgtacgttaacgtaaccggaaacggttacgttcggtaccggtcctaaggtcccaacggttccgtaactccgttaccgtccgttacccg

SEQ ID NO: 263177 - DNA, 758 bp, Homo sapiens
  misc_feature: GYAE6OF02GWBGN.8.33.C11.1.454.CMB.1.raw
  modified_base (370)..(370): a, c, t, g, unknown or other
  misc_feature (370)..(370): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagtattgtgttgacacagtcctccagccaccctgttctttgtctccgagggaaagacgcccacccgtctccgtgcgacgggccagtcaagaagttggttcggaccgtccgttacggtaagtccgttacggtaccaaaaccgaccaaaaccgtcgggtacccgagggtcccctcccgtccggtaccccctctacgttaccgtagttcgggtanaccctaactacccgaaacggaccgggaccctacgtcggaccctacgtaccccgacgtccgtaacggttcgagggtcgtacggtaggtgggtaacgtacgggacgtacgtaccttcacgtcaccacctatcctatacgacgtcgtaggacgtccgtagagtacgttcgttacgtgttaagtttcgtaccgtactaacgtaacttcggtccgttaacggtgggttcccggtacccgggtcccgggttaccgttaccgggtttccggtaacccggtaggtaaacccgtagggtaccggtaacgtacgtaacccggtaaacgtcgggttacgtacggccgtacccgtaacgtacccgtttctaccgtttacggtttacccaccgttacccgg

SEQ ID NO: 263178 - DNA, 699 bp, Homo sapiens
  misc_feature: GYAE6OF02IUIEU.8.33.C11.1.454.CMB.1.raw
  modified_base (295)..(295): a, c, t, g, unknown or other
  misc_feature (295)..(295): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaacttgggttttcctcgttgcttcttttaagaggtcgtccagtgtcaagtgcaacgtggtggagtcgtgggggaggcgtagtccagccgtgggagtcacagagacctctcctgtcgcacgtcctcgtggttccaccttcgagtacgctaccggnatgcacgtcgggtacccacctaaactccgaggcgaagggtgttgggaggtggggtcgacgttagtttcgttacagtcgtggacggtactaggtttcgttaacgtaagttcggttactacggtcgttacggacccggtaccggtagggaaccgggtcccgtacttacccgaacctacgtcccgtacgaacggtaacgaacctaacctaacccgaacgtaaacctaacgttaagttacgtttaacgttaacgtacctacgaaaccgtacgtaaccgtacgtaccgtaggaacggtacgtacgggttactaagtaccgtacgtagtaacgggaaggggaacgggaaccagggtaccgtacgttacgtaacgttcgttaccgttgaccggttcggtaccgggtaccgg

SEQ ID NO: 263179 - DNA, 764 bp, Homo sapiens
  misc_feature: GYAE6OF02HXFEE.8.33.C11.1.454.CMB.1.raw
  modified_base (479)..(479): a, c, t, g, unknown or other
  misc_feature (479)..(479): n is a, c, g, or t
  modified_base (571)..(571): a, c, t, g, unknown or other
  misc_feature (571)..(571): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagagattgtgttgacacagtctccagccaccctgtctttgtctaccgaaggggaaacaacccaccctcgtcctgccgaaggaccagtacagaattggtacggccgtccttacggtaagcgtacggtaaccaacgaactaaaccgtggaccaaggcctcccgacggtcccctctactcctagtggtcgacctaactaccgaaacgacgggccaccgtggaccacctcccgagtcccgaaggttaccgaagtcggacgtagggttacggggtaagtcgggaacgtacggttaaccttacgtaccgtaccttaccgaaccgttaanccgtaatcccgtaacggcccgtttagggaaccgtaccgtaaggaagttacgttcggttaacgtaccgtttaagttttaccgtaaccggtttnaaaccgtaaccgtacgttaccggtaaccgggttaggtaccggggttacccccggttccccggggtaaccgttaccggttcccgggtaccgttacggggaaaccctaggggtaccggacgtaacgtaccggtaaacgcgggttcgtaggaccgtcggactaccgtagttccgttacgtcttacgcccttaccgg

SEQ ID NO: 263180 - DNA, 861 bp, Homo sapiens
  misc_feature: GYAE6OF02IJ4UL.8.33.C11.1.454.CMB.1.raw
  modified_base (342)..(342): a, c, t, g, unknown or other
  misc_feature (342)..(342): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgttctttgtcctccgaggggaaagcgccaccctctcctgcgacggccagtcaagtaattggttcgggccgtccgtttacggtaacgtcgttacggtaacccaaccaaccgtaaaacccgtcggaccgacggaccctaccccgacggtccccctanactacttaagtggtcgaccactacccgaacgacgggtacctacgtcggactaaccgtcccgaacgtccgtaggttacaggtcggacgtagggttagggtacgtacgggaacgtaggtaccttcacgttactaccacacgtccagtccacgtccgtagggactaccgtaggaacgtcgttcggttacgtacgttttaacgttttaacgttaccgttacgtaaacccgttaacttaccgttaaccggttaccgggtaacgggtttcccgggggtaccccggggttacccggggggttacccttttacccgggggtttaccccgggtaccccggggttaaccgggggtaaaacccgggttaagggggtaaccggggttaacccgggtaaccggtttaaaacccggtaaaacccgggtttaacgggttaacgggttaccccggggtaccgttaacccgggtacccttaaacccgggttaccgtttcccggttaccggtttttaccccgttaccgttaccccgg

SEQ ID NO: 263181 - DNA, 745 bp, Homo sapiens
  misc_feature: GYAE6OF02GZLL7.8.33.C11.1.454.CMB.1.raw
  modified_base (314)..(314): a, c, t, g, unknown or other
  misc_feature (314)..(314): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgagggaacgacgccacctctcctgcgaggccagtcagaatgttcggcgtccttagagcgtaggtaccaacaacaaaccgtggccaggcctcccacggcccctacactctatggcncactccaaacgacgggccaacgtcggactacgtccccgaacgtccaggttcaggttcggacgtagggtggggttaagtacggggacgtacgtaacctttacaccgttctaccgtaacccattaccgacgtacgacgtccgtagggaaccgtcccgtaaggaagttacgttgggttacacgttttaacgttttaacgtttaccgttagttaacctaaacgttacgttacggttaacccggtacgggtcccgggacccgggtttaccccgggggtccttaacccggttttcccgggcccggttaacggggaacccggtaagggttacgggtacgtaacgtaacccgggtaaaacgtaaccggtttcggtaccgggtactaccggtaaccctaaccgttacgttaccgtttcggtttaccctttacgtaccccg

SEQ ID NO: 263182 - DNA, 656 bp, Homo sapiens
  misc_feature: GYAE6OF02H2Z2C.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttcgtctccgagggaaagcgccacctctacctgcgagggccagtacagaatgttggcgccttacgtaagctacggtaaccaacgacaaaccgtcggaccacggcctccacggcccctctactacttagtacggttgacacgtaccaacggacgggaccacgtggaccgactacccgagtccgtacggttctaacggtcggctacggtagggtacgacggggaactagtacctcgtacctcgtacaacctataccgtattcgaacgccttaggaccgtactacggaaagtattggtacgtacgttaatttaagttactacgtaactaactacgaccgttacgtagtccgggtaccgttcccggggacctaccgttccggtccggtaaacggtaccgaagggtacggaacgctaaccggaaactagtcggtacgacgtcgactacctagtctacgttcgtctaaccg

SEQ ID NO: 263183 - DNA, 648 bp, Homo sapiens
  misc_feature: GYAE6OF02J2DE9.8.33.C11.1.454.CMB.1.raw
  modified_base (119)..(119): a, c, t, g, unknown or other
  misc_feature (119)..(119): n is a, c, g, or t
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (505)..(505): a, c, t, g, unknown or other
  misc_feature (505)..(505): n is a, c, g, or t
tcagctcgcgtgtccacgaccggtgctcgatttagagtgagctcgttgggtttgggggaggaactgctcagttaggacccagagggaaccatggaagccccagctcagcttctcttccncctgctactctggcctcccagtttccagatacccaccggagagtattgtgttcgacacagttcctccagcccaccctgtctttgcctccgagggaancgcccaccctctcctgcgacgggccagtcagtactgtgctccttgagctgtacacacaactgcaggctccgcgccctnactctagtcggactcactaccgaacgtcgggccacggtcgactaccacccgacgtccgtaacggttccgaacgggtcggaccgtaggttcgggtacgtacgggaacctagtccgttacaacctcgtaccaccagtccactcgactccgtaggacgtctagaagtcgtggttacacgtagttttacttcgacgtacacgtctaccggtacgnggtccgccggttaccggccgttacgttcccgaccggtcgaaacggtgggtaccgtacgtagtaaccgtaaccggtacgtacggtacggacccgttagaccccgtacgttaaccgtccggtttacggttacctttactaccccg

SEQ ID NO: 263184 - DNA, 773 bp, Homo sapiens
  misc_feature: GYAE6OF02I80IQ.8.33.C11.1.454.CMB.1.raw
  modified_base (149)..(149): a, c, t, g, unknown or other
  misc_feature (149)..(149): n is a, c, g, or t
  modified_base (333)..(333): a, c, t, g, unknown or other
  misc_feature (333)..(333): n is a, c, g, or t
  modified_base (408)..(408): a, c, t, g, unknown or other
  misc_feature (408)..(408): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacttgggttttccncgttgcttctttaagaggtgtccagtgtcaagtgctaacgtggtggagtcgtgggggagcgtagtccagtccgtgggagtcacagaggactcctcctgtcgcagccttcgtgggttccaccgttcaggtacgcgtacggctagtcgctacgtcgggtcccaccaaactccgaggaccgaagggnttcgggacgtgggcgctaggtttgtttccgattcgtagggacggtctagggttacgtttacgaagtttggttacncggtccgtagggaacccgtcggttagggaacgggtccctaagtttcccgaaccgtaacgtccgtaccgaacggaacgtacccgtaacgttaccggaaacggtaaccctaacggtaaagttacggtttaaggttaccgggaacccgtagtaaaccgaccggttacccgttaaacgttccccggttaagggaacggtaacccggttaacgggttacttaaaccggtaaccgtttaacggaccgggttaaccgggtaacggggtaacgggggaaccctaggggtaacccggttacgtaacccgttaacggtaccgttaccggtttacggacccgttacgggtaccgggtaccgttaccgggtacccgg

SEQ ID NO: 263185 - DNA, 729 bp, Homo sapiens
  misc_feature: GYAE6OF02HMO7O.8.33.C11.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagaatgttggctccttcgtaagctaggtacaacacaaacctgccaggcctcccaggccccctgactctatggtcgcactccaacgacgggccaactggcactacccgagcccgtaaggttccaagtcggacaaggtgggtaatggggaactagaccttcacgtctcgaccagtcatacacgtcctagggacgccttagaaagtactggttacgacttaaggtttaactttacgtacgtttaccaaaccgtagttaccgggttaacccgtaagggtttccgggaccccgggtttacccgggggggtacccttaccgggttttaccccggggaccccgggttaacggggtaaaccccgtaagggggtttaaccgggacggtaaccggttaaacccgtaaaaaccgggttaacccggttagggtaacccgggtacgttaaccggacccgtaacccggttaacttccccgggtttaggtttaccctttaccgttaacccg

SEQ ID NO: 263186 - DNA, 679 bp, Homo sapiens
  misc_feature: GYAE6OF02F0XRN.8.33.C11.1.454.CMB.1.raw
  modified_base (314)..(314): a, c, t, g, unknown or other
  misc_feature (314)..(314): n is a, c, g, or t
tcagctcgcgtgtccacgaccggtgctcgatttagagtgagctcgttgggtttgggggaggaactgctcagttaggaccccagagggaaccatggaaagcccagcgcagcttctcttcctcctgctactctggctcccagagacgaccggagagattgtattgacgcagtctccaaccaccctgtctttgtctccgtgggggagagccacccgtctcctgcagggccagtcgaaccttttagtagtagttatttagcctggtatcggacaaaaacctggccagcctcccgactcctcttcttggtgagcctacnggccacgtggacaccccagaccaggatcgagtggacgaggccgggtctggggacagtacttcgactttccgaccaccagtacaaacaagtacctgaccacggaccctaggaaagtagttacttacgacttaacgtttttactactttacgaccgaacgttcgtaagttaagttcgttaacccgttccccgggttaggtacccggtttccgggaaccgtaacggggtaaacccgtagggttacgaccgtaaacgtacccaaaccgtaacgtcggtacggtcttacgacccaaccgtagttccttacgttaccttaacgtactttcccgttaccccgctaccgttaccgtacggacgtaccgaccgg

SEQ ID NO: 263187 - DNA, 727 bp, Homo sapiens
  misc_feature: GYAE6OF02JACR0.8.33.C11.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (406)..(406): a, c, t, g, unknown or other
  misc_feature (406)..(406): n is a, c, g, or t
  modified_base (476)..(476): a, c, t, g, unknown or other
  misc_feature (476)..(476): n is a, c, g, or t
tcagctcgcgtgtccacgaccggtgctcgatttagagtgagctcgttggggtttgggggaggaactgctcagttaggacccaggagggaaccagtggaacgccccagctcagcttctcttcctcctgctactctcggcctccctagtttcagactaccaccggagagattgtgttgacacagtcctccacgcccacctgttctttcgtcctccggaaggggaaacncgacccaccctctccngcgacgggccagtacagatcggttcggcctcgttcggaacgcgtacggaaccaacaaccaaccgtcggaccgacggcctaccccgaccggtccccctataccttctacgttcggtacgacctactacccgaacggaccgggacctacgtcgcctacctacccgngtacccggtaggtcacggtcgacggtaggtacgggtagtacgggactagtcctacacgtctaccgactanactacgtcacgtcgtacggacctacggtagacgttagtggtacttaattacgtttactacgtcaaccgtactagtaccgtacggtacggtccgggtacccggtacgggtcttacccgggttaccgggtcccggaaacgggtaccggtacggggtaacggtcgaaaccgttaacgggaaaccgttcggcggttaacggtccgtacccgaccgtaaccggttcctttcccggtactttacccgttacccaccg

SEQ ID NO: 263188 - DNA, 688 bp, Homo sapiens
  misc_feature: GYAE6OF02H4Q5Y.8.33.C11.1.454.CMB.1.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaactgttggcgtccgttgtaagctggtaccaacacaaacctggccgacggcctcccgacggtcccctacactctatggtgctactccaacgacgggaccacgtggcactcccagcccagggttccaggtcggacgtagggttgggtagtcgggacgtagtaccttcgaaccttcgtaccaaccgtattaccactactacggtcccgtagggtaccgtaccgtaggaaacgtagttcgttacggtactttaagttttaactttaccgtacgttaacctaagtacgttaccggaaccggtgggttacccgggcccgggtacccggggtacccgttaccgtttccgggcccgtagggtaacccgagggttcggaactcggtaaccgtaacggtaaccgtcggtaggtaccgacggtccgaacccttgtacccgtttagttcccttacgtaccc

SEQ ID NO: 263189 - DNA, 732 bp, Homo sapiens
  misc_feature: GYAE6OF02HYTFJ.8.33.C11.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagctcgcgtgtccacgaccggtgctcgatttagagtgagctcgttgggtttcgggggaggaactgctcagttaggacccagagggaaccatggaagccccagctcagcttctcttcctcctgctactctggctcccagtttcagatacccaccggagtagtattggtgttagacacgtagtcctccaacgcccacccttgtctttgcctcgagggaanacgccaccctntcctgacagggccagtcagtaagttggttcggacctccgtttagtaacgccgttacgggtaacccaaaccgtaccgtaaaacccgtacggacccgtaacggtccctaccccggaccgggtcccctacacgttaccttacgtgggtacacgtacctaaccgtaacggaacggccctacggtaccggacctaaccgtcccgaacggtacccgttacggttaccggtaaggtcggtaacccggtagggttacggggtaacggtcgggtaaactacgttaacccgttctaaacccttccgtaaccctaactacgttacctaacgtccgacgttccggtacggtacgtacgtaagacgttacgtgtcgattagttacgtgtagactagtcgtacgtaacgcgtacggtaccggtccggtacctcgtaccgcgtaacgtaacgtagacgtagtactacgaacgtacgtgtcgtctacgctaacctcgttacgtcgttctacgtaccg

SEQ ID NO: 263190 - DNA, 709 bp, Homo sapiens
  misc_feature: GYAE6OF02JCGIE.8.33.C11.1.454.CMB.1.raw
  modified_base (205)..(205): a, c, t, g, unknown or other
  misc_feature (205)..(205): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctggctcccagatacccaccggagaaattgtgttgacacagtcctccagccacctgtctttgcctcgaggggaaancgccacctctctgcagggccagtctagtgttagctaacttgcctggtaaccaactagaaacctggaccaggcccttcccgaggtcctcctcacttccgtcgtagtaactaaccgactaccccgaaacggaccgggcctaaccgtcgggacctacctaccccggaacgccccgtaagggttccaacgggttcggacgtagggttcggggctagggggaccagtccttcgactctcaacgtntcacggacncgacccgtagaccgtaccttaggaaacgttacgtttacgacctttaacttttacgttaacgtcgtaccggacggtacgtacggttaacgtaaccgttaacgttccggttcctttaccgttaccggttaccggtaccggtaccgggtaacctaagggttcggtaactaaccgtaacgtaacgtacgttggtacgtactacggacctacgtacgtacgttcgttacctactacgtttcccgtcccgtactacgttcg

SEQ ID NO: 263191 - DNA, 695 bp, Homo sapiens
  misc_feature: GYAE6OF02G9MUB.8.33.C11.1.454.CMB.1.raw
  modified_base (159)..(159): a, c, t, g, unknown or other
  misc_feature (159)..(159): n is a, c, g, or t
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (321)..(321): a, c, t, g, unknown or other
  misc_feature (321)..(321): n is a, c, g, or t
tcagctcgcgtgtccacgaccggtgctcgatttagagtgagctcgttggggtttgggggaggaactgctcagttaggacccagagggaaccatggaagccccagctcagcttctcttcctcctgctactctgcctccagagatcattggagaagtggtnangtacanacgtctcggtcaccctgtcttgttttccgggganagcgccnccctctccgtgtcgcgccgtagtcgagnggtcggttaagaaccgtaacttacggccgtaggtactacgacgcgaggacgccgtacggcgacggccctccaacgccgtcccttntaccgttcgttcggtccgttaccgttaacgacgggaccctaaggtacgtaactccccgagaccgtacggttcacggtcggtgacggttcgggtcgtcggtaacttccgtactactacctacgacctactactaacgtaccgatacaactcgtactacgttacgttacgtgttaacgttttctttcttgtacgtacgacgttacgtagtacggtaagtcggtccgttaccgttaccgttacggttccgggtacgggacccggacggtaaggtccggaaccgttaaaccgaaccggtattaccgggtgtaccggtcggacaaccctcttacgttaccgtcttaccttacccgttccgacccgttccgtactaccgg

SEQ ID NO: 263192 - DNA, 685 bp, Homo sapiens
  misc_feature: GYAE6OF02H2DVZ.8.33.C11.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaaagngcccaccctctcctgcagggccagtcagaatgtgcncttgaagctggtacaacacaaacctgccaggcnccagcccctnactctatggtcncactccaacgacggccatggcactccacgccaggtcaggtcggcacggtgggtangggacagtactctaccgtctcaccatacactcagtccgtaggactacgtaaggtaaacgtgttacggttacgagtttaacgttttaacgtttactacggttaacctaacgaccgttaccggtaacgggtaacgggttccgggtaccccgggtttaccccggggggaacctttacccggttttaccgggggaccccgtttacggggaacccggtaagggggtacgtaaccgggttaaactacggtaaaaacccggtaccggttacggtaccgggttaccgacgtaccggtaaccctaggttaccgttaccgttcgttacccttaacccg

SEQ ID NO: 263193 - DNA, 763 bp, Homo sapiens
  misc_feature: GYAE6OF02G5AYF.8.33.C11.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagtgagctcgttgggtttgggggaggaactgctcagttaggacccagagggaaccatggaagccccagctcagcttctcttctcctgctactctggctcccagtttcagataccaccggagagattgtgttgacacagtctccagccaccctgtctttgtctccgaggggaaagngccacctctcctgcagggccagtcagaatgttcggctccttgtaagcgtggtaccaacaacaaacctggccaggcctcccacgggccccctcactcctaagtcgggtcgcactaccaaaccgtacggggcctaacgtcggcgactcccacgcctacggttcagtcgggcaggttggggtagtggggacacggtactttcaaccttcgtaccaccgactaccagtaccacgtccgttgggaccgtcccgtaggtaaacgtacgttggtttacgtacgttaagttttaacgtttacgttaacggttactaaaccgttacggttaacccgttaaccgggtaacggttcccggggtacccgggttcccgggggggtacccctttaaccgggtttcccgggtaccccgggttaccggggtaaacccggtaacggggttacgggagggttaaccgtaaacccggtaaaacgggtaaccgttaggggtaccgggtaccgtaccggtaacccggtacccgttaacgttcggtttacgtttacccgtttactttacccccgg

SEQ ID NO: 263194 - DNA, 805 bp, Homo sapiens
  misc_feature: GYAE6OF02GPZXD.8.33.C11.1.454.CMB.1.raw
  modified_base (215)..(215): a, c, t, g, unknown or other
  misc_feature (215)..(215): n is a, c, g, or t
tcagctcgcgtgtccacgaccggtgctcgatttagagtgagctcgttagggtttggggaggaactgctcagttaggacccagagggaaccatggaagccccagctcagcttctcttcctcctgctactctggctcccgagtttcagataccaccggagagattgtgttgacacagtcctccacgcccaccctgtctttgtcctccgagggaaacncgccaccctctcctgccagggccagtacaagtaacgttggttacggccgtccgttacgtaagccgttacggtaacccaaacaacctaaaccgtcggacccgaacggtaccctccccggaccggaccccctacgtaacttaccgttaacgttcggggtacgacctaacgtaccccgaaacggaccggggacccctaacggtcgggacccaacgttaccccgaacgggtcccgttaaggttaccgtagggttacggaccgttaaggggttcgggttaacgtagggggtaaaccctaaggtaccctttacgaccgtttacccaccgaaccctaagtacctacgtaccgaccgtcccgtagggaccctaccgtaagaacgttagttacgtacgtacgttaagttttacttacgtacgttaacaacgttacgtaccgtaccggtggtacccggtcccggtaccgggttccttacccggtttccggacccggttcggaaacccgtagggtacgtacgtaaccgtaaccgaaacggttacgtgggtaccgacgtaccgtacgtaaccttccgtacgttaccttaccgttacctaccg

SEQ ID NO: 263195 - DNA, 762 bp, Homo sapiens
  misc_feature: GYAE6OF02FJ300.8.33.C11.1.454.CMB.1.raw
  modified_base (347)..(347): a, c, t, g, unknown or other
  misc_feature (347)..(347): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccgggagagtattgtgttgacacagtctccagccacctgtctttgctccgagggtaagcgcccaccctctcctgccgagggccagtacaagtaattggttacggcctccgttcggtaagcgttacggtaacccaacgaacctaaccgtcggaccgacggccctccccgacggtccccctacactctagtcggtcncctacgtacccgaacgaccgggaccacgtcggactaactccccgaacggtccctagggttacgaacggtcggacgtagggttcggggtaacgtcgggaacctaggtacctttacaccgttacgtacccaaccttaagtctaaccgtcgacgtccggtacggtactacccggtaagaacgttattcgggttcttaccgtttaattttaacgttacgttacggtactaacgtacttaccgggtaccgtacggtccggtcccgggttcccggggactttacccgggttcccggtaccggttaacggaaccggttacgggtagggtaccgtacgtaaaccggtaaacggtacgttcggggtaaccggtccgtaccggtccgaacccttgttacccggtactttcccgttattaaccccg

SEQ ID NO: 263196 - DNA, 713 bp, Homo sapiens
  misc_feature: GYAE6OF02FMULY.8.33.C11.1.454.CMB.1.raw
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcaggccagtcagatgttggcgccttcgaanctggtaaccaacacaaactggccaggcctcccgaggcccctgactctatggtcgccactaccaacgtacgggcccaacgtcggactaacgtccccgacggtcccgtaaggttcacggtcggaccgtaggggtgggttaacgtacgggggaacctacggtaaacccgtttcctaacgtttacccgtacgtaacccctaacttcccgttaacgtaccgaccggtacccgtttacgggaccgtccccgttaagggaaacgtacgttacggtttacgaccgtttaaggttttaacttacgttacgtactaaacgtcgtaccggtaccgtacggtcgtacccggtcggggcccttacggttccggccgtacgggaaccgtaggtcggtacgtaacgtacccgtaaaggtaccgttaggacgtcgacggtacccacgtacgttacgtacgtttccctattcccg

SEQ ID NO: 263197 - DNA, 798 bp, Homo sapiens
  misc_feature: GYAE6OF02HASEO.8.33.C11.1.454.CMB.1.raw
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
tcagctcgcgtgtccacgaccggtgctcgatttagagtgagctcgtgggagaggagcccagcactagaaggtcggcggtgtttccattcggtgatcagcactgaacacagaggactcaccagtggtaggtttgggcttaggtaacgtttcggggttttttcctcggtttcgtacctttacgtttttaaaggcgggttcgtccgtaggttcgtactaagttcgaccgtaacgtggggtaggaggttcggtaggggggaggtccggttacggtccgaacggtcccggtagggggtaacggtccaacgtaggacgtaccttccgttaccgtggtccgcaccgtccttcggttacggttctaccttagagtcgccgtacgcacgtagcctacggtccggacccacaaccgcggaaggacgaagggtgtacggagggtcggtaggtcttaggtttgtacgagttcggagggacggtntagggttntacgtaaggttcgttagtcgtacgtggaccggtacggagggaccggtctactacgacctctaccgacgaacgaccaacgtaccgacgtaacacctagttaacgttcgttaacgttacgactagaacgtaccgtacgacgtcgaacggtacgtacggtacggtttactaacggtaacgttacgggaagggtaaccgggacggggtaacgggtaaccgggtaacggtaccgggtttaacctaaccgtaccgggttttaaccttcgggttaccggttaaccgggttcgggaacccgggttacggtaccccgggtttacccg

SEQ ID NO: 263198 - DNA, 789 bp, Homo sapiens
  misc_feature: GYAE6OF02H6WVQ.8.33.C11.1.454.CMB.1.raw
  modified_base (382)..(382): a, c, t, g, unknown or other
  misc_feature (382)..(382): n is a, c, g, or t
  modified_base (470)..(470): a, c, t, g, unknown or other
  misc_feature (470)..(470): n is a, c, g, or t
  modified_base (508)..(508): a, c, t, g, unknown or other
  misc_feature (508)..(508): n is a, c, g, or t
  modified_base (586)..(586): a, c, t, g, unknown or other
  misc_feature (586)..(586): n is a, c, g, or t
  modified_base (601)..(601): a, c, t, g, unknown or other
  misc_feature (601)..(601): n is a, c, g, or t
tcagctcgcgtgtccacgaccggtgctcgatttagagtgagctcgtgggagaggagcccagcactagaagtcggcggtgttccattcggtgatcagcactgaacacagaggactcaccagtgggtagtttcgggctagtaacgttcgggttttccctcgttgtcctttacgttttaaggaggttccgtacctaaggttgtacgtaaagtcgaccgtaaaggtgggtggtacgtcggtaggggggacgtcgttcggcccgaggtccgtagggtaacgtcacgaaggtactaccttcggtacgtagcggactacggtcccttcggttcggttaccttaccgtacgaagttaacgtacggctagtcgtaccgacgttcgggaccncctaacgtccaccggtaaggacgtaacgggtgttaggggacgttcgggagtcgttaggtttactttcgaagtccgggtaggtacggtnttaaacggtcgttaacaaggtttgaacgttcggaaccncggttaccaccgggttaagggaccgtaccgttacgctaacgtcgtacgtacgaacgactacgtaactacgacggtaanaacgtataacggttntaggtacctagtacgaactacgtacctacgtcgaacgggtcaaccggttacgtacgtagtaaccgtaaggtaggtaacgggacggtaccgggaaccggtaggtccccggttaaacggtccgttaaccggttaacggtcccggtttaccggtaacccgggttacgggtaccggttaccgggtaacccgg

SEQ ID NO: 263199 - DNA, 779 bp, Homo sapiens
  misc_feature: GYAE6OF02FQ1FB.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttccttttgtccttccgaaggggaaaacgacgcccaaccctccttcctgccgacgggccagtcagtaatggttggcgtccttacgaagctacggtaaccaacaaccaaacctggaccaggcctccccgacggtcccctcactcctagtggtcgactactaccaacgacgggaccacgtggacacgtccccacgacccgtacgggttaccgaggttcggacgtagggttcggggtagtacggggaactaggtaccttaccgaccgttcctaacccgaccctactacctacgttaccgaaccggtcccgttacgggacgtacccgttaggaacgtagtttcggttacggtacgttaagtttttacttaacgttacgtacctaacgtacgttccggtaaccgtggtcccggggtcccggttacccggggtccctttaacccgggttttcccgggacccggttaccggggtaaaccggtaacggggttacgggtaaccgtaccgttaacggtaaaaccggttacggttacgggtaccgggtacgtacgtacccgtaccttacggttccgttcggttaccctttacggtaccccg

SEQ ID NO: 263200 - DNA, 804 bp, Homo sapiens
  misc_feature: GYAE6OF02F1VR4.8.33.C11.1.454.CMB.1.raw
tcagctcgcgtgtccacgaccggtgctcgatttagagtgagctcgttgggtttgggggaggaacctgctcagttaggacccagagggaaccatggaagccccagctcagcttctcttcctcctgctactctggctcccagtttcagataccaccggagagattgtcgttgacacagtctccagccaccctgtctttagtctccgtaggggaacgagcctaccctctccctgaccgacgggccagttaccgagtaatcggttacggccgtcctttacgaagtccgtacggtaccaaaccgaccaaacctgggtcccacgggtaccttcccccgacgggtcccccttacggacttaccgtacgttacgggtacgtaccgtaaccgttacccgaaaaccggtacggggtacccaaccggtttcggggacctaaccgtacccccgtaaacgtccccggtaacgggtttaccgaaccggggtttcggacgtaaccggggttgggggttaaactaccggggggtaaatacccggttaaaccgtttacccggtaaacccgttcccggttaaccctacccggtaaccgttacccgtaacggtaccgttaacccgccgttaacgggtaccgtaaccgttacggaacgtagttacgtcgtacttacggtttattacttcggacctaatcgtacgtccgtacgtcggtccgtaccgggtcttccggttaccgtcgggtacgacgagggtacgtacgacgtacgtaaacgtcgtcggtacgtcaccgtcgactacgttctcggttctaccgttccg

SEQ ID NO: 263201 - DNA, 883 bp, Homo sapiens
  misc_feature: GYAE6OF02INBOU.8.33.C11.1.454.CMB.1.raw
  modified_base (355)..(355): a, c, t, g, unknown or other
  misc_feature (355)..(355): n is a, c, g, or t
tcagctcgcgtgtccacgaccggtgctcgatttagagtgagctcggttggggtttgggggaggaactgctcagttaggacccagagggaaccatggaagccccagctcagcttctcttcctcctgctactctggctcccagtttcagactaccaccggagagtattgtgttgacacagtctccacgcccacccttgttcctttcgtcctaccgaaggggaaagcgccctaccctcgtcctgcgacgggcctagtcgaagaatcggttcggccgtccttaggtaacgcgttacggtaaccaacgaacctaaaccgtcggacccgaacgggaccctaccccgaacggccccccttanacttccgttaacgtcggttacgacctactacccgaaaccgacgggaccctaacgtcggaccaaccgtcccgacgtaccgtacgggtactacggtacggacgtaggggtcgggtacggttacggggaacgtaacggttaccttaccgtaccgttacctaccgtaacctacgttactaaccgtacgtaaccgtcccggtacgggtaaccgtaccggtaacggtaaaggtcgttaccgggttacgttaacggtttaacgtttttaacggtttaacccgtttagttaaacccgttaaacggtaccgttaccgggttaacccggtaacggggtttcccggggtacccggggtttaccccgggggtaccctttaacccgggtttcccgggtaccccggttaacgggtaaaccggtaacggggttacggtaccggtaaccggttaaccggaaacggttttaacggccgggttaacggtaccgtacggtacccttaacggtaccgttacgttcggtttacccttacgttaacccgg

SEQ ID NO: 263202 - DNA, 901 bp, Homo sapiens
  misc_feature: GYAE6OF02HEXU9.8.33.C11.1.454.CMB.1.raw
  modified_base (212)..(212): a, c, t, g, unknown or other
  misc_feature (212)..(212): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgcctactctggcctcccagtttcagataccaccggagagattgtgttgacacagtctccagccaccctgtctttgtctccgaggggaaagngccaccctctcctgcagggccagtcagaatgttggcgtccttcgtaagctggtaaccaaaccaacgaaaaccctggacccaaggcctaccccgacggccccctcaattccttaagtcgggtacacctacttaccccgaaacgacggggtaccccaaccgtgggacctaacgtcccccgaagccccgtagggtttccaaggttcggacgtaaggggtttaggggtaacttacgggggaaacctaaggaacccttttaccgaaacccttcccgttaacccgtaaacccctaattaccgtaaacgttacccggtaaccggtacccggttaaccgggtaaccgggtaccccgttaagggtaaacggttaacgttacggtttaaccggtaccgttaaagggtttttaaacttttaaccgttacggttaactaaaaccgttaccgtttaacccgggtaaacccggttaaccgggttaccggggttacccccggttaccccgggggggtaccccgtttaacccgggttttccccggggttaacccccggttaaccgggggtaaaccccggttaaacggggtaccgggtaacggtacgttaaaccggtaaaaccggttaaccgtacgggttacggtaccgtaacgtacccgtaacccgtaaccgttaccgttaccggtttaccttaccgttaacccg

SEQ ID NO: 263203 - DNA, 807 bp, Homo sapiens
  misc_feature: GYAE6OF02J1WHA.8.33.C11.1.454.CMB.1.raw
  modified_base (751)..(751): a, c, t, g, unknown or other
  misc_feature (751)..(751): n is a, c, g, or t
  modified_base (769)..(769): a, c, t, g, unknown or other
  misc_feature (769)..(769): n is a, c, g, or t
  modified_base (796)..(796): a, c, t, g, unknown or other
  misc_feature (796)..(796): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagactaccgaccggagagtattgtgttgacactacgtcctccgaacgccctaccccgttgtcctttttgtccttacccggaagggggaaactacggcccctaacccgtttccctaccgttcgcccggaaggggtccctaggtaccgaaggtaacgttggtttcgggaccgtccgtttaccggtaacgtccgttacgggtaaccccaaacgtaaccgaaacccggttcgggaccctaacgggaccccttccccggtaaccggccccccttagtaacggttccctaaggttcggggtacaacctaacgtacccccgaaagggtaaccgggcccctaagttcgggacccgtaccctacccggaaccgtcgttacggtaacgtcgggttaccggacgttacgggttcgggtaacgtcggggacctaaggttccgtactaccgtattacccgaccatttacaccgttacgaaccgtctcggaaccgtcgttaggaaccgttggttcccgttagtccgttaacgtttaaacctcgttaacgacctaagtaccgttccgtaaccgtggccgtccgggtacgacccgttacgtcgggacctaggaaaccgtggttnacgtagacctaaggtcgntccgtacgctacggaacctgtaccgtnttcctataccg

SEQ ID NO: 263204 - DNA, 625 bp, Homo sapiens
  misc_feature: GYAE6OF02GVWJM.8.33.C11.1.454.CMB.1.raw
  modified_base (283)..(283): a, c, t, g, unknown or other
  misc_feature (283)..(283): n is a, c, g, or t
  modified_base (571)..(571): a, c, t, g, unknown or other
  misc_feature (571)..(571): n is a, c, g, or t
  modified_base (612)..(612): a, c, t, g, unknown or other
  misc_feature (612)..(612): n is a, c, g, or t
  modified_base (620)..(620): a, c, t, g, unknown or other
  misc_feature (620)..(620): n is a, c, g, or t
  modified_base (623)..(624): a, c, t, g, unknown or other
  misc_feature (623)..(624): n is a, c, g, or t
tcagctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtgcagttgtttcatctgagggcagtgttcaatggtatgctgacgccgtagaagggccgattcaccatctcagagacactccagacacaatgtattggacctgaacagacctaagtctggaggacagggtntactactacgtagacggaagggacggggaaccaggcgggtacgtaccgaagtccttacgttggacgttcggtacggggccgtacggggtaccctcggtaccaccgttcctcctcacgtccctacccgaccgaccggtcccacgttcccggtacccgttcccccgtacggccccgtccccgtcgtcccgtaccgacggtaccgtcccgacccgtcggaacgaccgcgaaccgcgggcccgccgtcgggcctcggtccgtagtaccgacggtaccttaaccgtccgaacncgtccgagtccgtaggaccggcggcgtacggacgacgccgnacgtacgntgnng

SEQ ID NO: 263205 - DNA, 687 bp, Homo sapiens
  misc_feature: GYAE6OF02JFONS.8.33.C11.1.454.CMB.1.raw
  modified_base (225)..(225): a, c, t, g, unknown or other
  misc_feature (225)..(225): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
  modified_base (653)..(653): a, c, t, g, unknown or other
  misc_feature (653)..(653): n is a, c, g, or t
tcagctcgcgtgtccacgaccggtgctcgatttagagtgagctcgttgggtttgggggaggaactgctcagttaggacccgagagggaaccagtggaagccccagctcagcttctcttcctcctgctactctggcctcccagtttcagatacccacggagagtattggtgttgacgactgtcctccgagccctacccgtgttctttgtccgtccggaggggaaancggccctaccctcctccgtgacgacgggcctacggtcaggtaagttcggttcggccgtaccgttcgtaacgcgtacggtaaccaacgtaaccaaaccgtcggaccgaacggtcccacccgtacggtacccctacgtaactacgtcgtcgggtctacctacgaccgtaacggacgggcctaacgcggactactccgagtacccgtagttcnggtacgcgtaggtggtacgtcgacgtatccgtacncgttcaccacgactcgnttaccgcgtcgtacggcgtaccgaggtacgtagttcgtgacgtttaagttacttactgtacctaacttacgacccggttagacggttaccggtcccgtaccggcttcggtaccggcgtaacgggaactgggacggtatacgtaacgacgtaacgtggtactacgtnaccttaacgtcgttacgtcgttactcgttacccg

SEQ ID NO: 263206 - DNA, 713 bp, Homo sapiens
  misc_feature: GYAE6OF02FWTSQ.8.33.C11.1.454.CMB.1.raw
  modified_base (269)..(269): a, c, t, g, unknown or other
  misc_feature (269)..(269): n is a, c, g, or t
  modified_base (668)..(668): a, c, t, g, unknown or other
  misc_feature (668)..(668): n is a, c, g, or t
tcagctcgcgtgtccacgaccggtgctcgatttagagtgagctcgttgggtttgggggaggaactgctcagttaggacccagagggaaccagtggaagccccagctcagcttctcttcctcctgctactctggcctccagtttcagactaccaccggagagtattgtgttgacacagtctccagccacctgttcttgctcgaggggaacgcccaccctctccgtagcgacgggccaggtcaagtaatggttcggctccgtttacggaancctacgggtaacccaacgaactaaaccggtggtaccacgggtaccctaccccgacgggtccccctactactaccgttaatcgggtacaccgtactacccgaacgacgggcctaacggtcgactactacccgagtccggtacgtctggttacggcgtagggttgggtacggtacgggactacgtacgttacctagtacctacactactacgtactcgtacgacgtcggacgtcaggtaacgttgtacgtgacgtttacttaactcgtactaacgtactacgttccggtaactcgggccggttccggtaaccggttccgtaccgggtttccggacccgtacgggtaaaccgtggtaccggtacgtaacgaaccggttaacgtaccggttaggtccggtacncccggttactaccggttattaccggtcgttacctttacgtacccg

SEQ ID NO: 263207 - DNA, 902 bp, Homo sapiens
  misc_feature: GYAE6OF02IY17A.8.33.C11.1.454.CMB.1.raw
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctagaacttgggttttcctcgtttgcttactttttaagaggtgtcctagtgtacaagtcgacaacgtggtggagtcgtgggggagcgtagtccagccgtgggagtcacgagacgactctccgtgtgcacgcctgtcggtctaccgttgaacgttacgacgtaccggcacgttcgaccgtacgttcgggtaccccgaacccgtaaacgtcccggaaggtaccggtaaaggggtacgttaggggacggttggggtcggtacgttacggtttttcggttacagttccggtacggtacgggtacgttaaggttcgtttacgtaaaggttcggtttaagtccgtcgttacggacccgggtaccggttaggggaacggtccgttaacttacccgtaaccttaccggtacctacccggaacggtaaccgtaacccgtaaacccgtaccggaaacgtaaaccgtaaacgtaacggtttacgttaacggtttacgggtaaacccgttaacgtaaacccgtaacggtaacccgttaaccggtacccggttaacgggaacgggttaaccccggttacgggttaaaccgttaacgttaaccgttaaccggttttaacggaaaccggggggtaaaccgggggtaaaccgggggggttaaacccgtaccggggggtaaccggttaaccggtttaaccccggttaaacggttttaccccgtttacccggggtttaacggtaaccccggggtttcggggaccccggggtttaaccccggg

SEQ ID NO: 263208 - DNA, 638 bp, Homo sapiens
  misc_feature: GYAE6OF02FISHX.8.33.C11.1.454.CMB.1.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
  modified_base (585)..(585): a, c, t, g, unknown or other
  misc_feature (585)..(585): n is a, c, g, or t
tcagctcgcgtgtccacgaccggtgctcgatttagagtgagctcggttggggtttgggggaggaactgctcagttaggacccagagggaaccatggaagccccagctcagcttctcttcctcctgctactctggctcccagtttcagataccaccggagagattgtgttgacacagtctccagccacctgtctttgctcaggggaaangccacctncctgcagggcagtcagaatgttggcgccttcgaagcgtggtaccaacgacaaaccgtggaccaggcctccccgaggccccctanatcgacgtggngtccaatcccgaanagggcctaacgtggcatcccagcctaggtcagtggnaggtggtactagggacagactcgactcgcaccagcatcgagccgtaggntccgtagaagtagttacgttgcttaaggtttactaacgttcgtaccgaacctacgttacgtaaccggtaggtacgggtcccgttacccgggggtaccgtacgttttccgggcccgttacgggaccgtaacgggaggtacgtaagtaccggtaaaacgtaaccgtcgggttaccgnggtaaccgtacccgaccgttacggtacctcggttacccttacggttaaccccg

SEQ ID NO: 263209 - DNA, 674 bp, Homo sapiens
  misc_feature: GYAE6OF02GCUTD.8.33.C11.1.454.CMB.1.raw
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (499)..(499): a, c, t, g, unknown or other
  misc_feature (499)..(499): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctcgagggaaagngcccaccctctcctgcacgggccagtcagaatgtggctcttgtaacgctgtaccaacacaaactggccaggccnccccgacggcccctcactctatgggtcncactaccaacggcgggacccacgtcggcacgtcccagcctaaggttcgaggtcgcgaggttgggtactaggggactaggtaccttacgacttcctccacctacgtcattaccgacgtccgtagggacgaccttaggaaagtagttcgttagtaaccttagttttacttaacgttactacctaaaccgtnttacccggaacgtacgggtccggtaccgggtacccggggtccttacggtttccgaccccggttacgggaccgtaacgggtagtacgtaacgtaacccggtaaacgtaacggttcggtacgggtaccgtacgggtacccaccgttacgtttccggtcttacccgttactaaccccg

SEQ ID NO: 263210 - DNA, 674 bp, Homo sapiens
  misc_feature: GYAE6OF02H5AK1.8.33.C11.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (587)..(587): a, c, t, g, unknown or other
  misc_feature (587)..(587): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgagggaangccaccctntcctgcaggcagtcagatgtgctccttganctgtacacacaaactgccaggctccgagccctnatatatggtncactaccaacgacgggccacgtcggactactccccgaggacccgtaggttcaggttcggaccgtaggttaggggtacgtcggggtaacacgtaccttacgtacctccgtaccaaccctatccgaagtccaacggtccctaggggacctccgtaaggtaacgtcgttaggttacgtaccgtttaagtttacttacgttacgttaccctaaagtccgttaacggtaccggtaagggttcccggtaccgggtacccggggtcccttaccggtttcccgggtaccgacgggtaacggtacggnggactacggttaaccggaaagttaacccggttggacggtccgtacggtaccctaacgtacgttcctttacggttacttacctacccg

SEQ ID NO: 263211 - DNA, 686 bp, Homo sapiens
  misc_feature: GYAE6OF02J2SFT.8.33.C11.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (546)..(546): a, c, t, g, unknown or other
  misc_feature (546)..(546): n is a, c, g, or t
  modified_base (632)..(632): a, c, t, g, unknown or other
  misc_feature (632)..(632): n is a, c, g, or t
tcagctcgcgtgtccacgaccggtgctcgatttagagtgagctcgtgggaggaggagcccagcactagaagtcggcggtgtttccattcggtgatcagcactgaacacagaggtactcaccatggagtttgggctgaacctgggttttcctcgttgcttcgttttaagnggtntccagtgtcaagtgcaacgtggtgagtcgtggggancgtagtcagccgtgggagtcacagacnctctcngtacgcacgcctgtcggtccacctnagtanctacggcatgctacgttcgggacccacctaaccgccgaggaccgtaaagggtnttggggacggttcggggtgtccgtaaggttttccggttnacgtaccgtgggtacgggtccagtttcgtaccgaagttcgggtaattcggctaaccgggtaaccggtaccggtagggtaacgggccttgttacccgacgtactttccaccggaagaccttaccaaccgtaccgtaagaaccgtaagaacgtttagtacctttaggaaccctagggtaaaccncccgttttaaacgacgttaccggtcgtaaacggacccgtagggttacctagtaaccgtatacggaacgggacgggtacggaaccgngtacggtctaccgtagtaccgttcgtaaggcgttcgtagggacctcggttaccg

SEQ ID NO: 263212 - DNA, 742 bp, Homo sapiens
  misc_feature: GYAE6OF02FM1KJ.8.33.C11.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgactacagtctccagccaccctgtcttgtctccaggggaaangccaccctntcctgcagggccagtcagagtgttaccacccagttagccttggtaccaacacaaacctggaccaggccttccccaggcccctcattcctttcgacttggacctagtcccagtaccgacggggacctacgttcggaccgaacttccccgacgtacccgaaggtttccgaagtcggcgtacggttacgggttcgtacgggggaacctacggaaccgtttacgaaccttcgttacccaacccgtacgtaccaagtaccgaacgtcccgtacgacgtaccgtagaagtaacgtttgaccttaagttttacgttacgtacgttccgaaacacgttaccgttaaccgtacgttcgggtacccggtcccggggtacccgttaaccgtttcccgggtcccgtaaccgggtaacccgttaaaagttccgtaaggtacctaacgaaacccgtttaacggtacgttaaccgggtacgttacgaccgtaacccgtagttaccgttacggtttacctttacccgtactttaccccgg

SEQ ID NO: 263213 - DNA, 712 bp, Homo sapiens
  misc_feature: GYAE6OF02FW7IR.8.33.C11.1.454.CMB.1.raw
  modified_base (173)..(173): a, c, t, g, unknown or other
  misc_feature (173)..(173): n is a, c, g, or t
  modified_base (345)..(345): a, c, t, g, unknown or other
  misc_feature (345)..(345): n is a, c, g, or t
  modified_base (677)..(677): a, c, t, g, unknown or other
  misc_feature (677)..(677): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctgctcccagtttcagataccaccggagagtattgtgttgacacngtctccagccacccttgttctttgtctccgaaggggaaacgcgcccaccctctccgtgccgaggccagtcagtaactggttcgcgtccttcggtaagccgtacggtaaccaacaaccgtaaaccgtcggaccaacggtcctaccccgacggccctcaacttcctagtggacncaactaccaacgtcggacctacgtcggctacctcccgagtccgtacggttcaggtcggacgtagggttgggtaacgtcgggaaccgtacggtaccttaccgtacgttcctaacgaacctactacgtacgtaccgtaacggtccgtaggactccggtaagtaaacgtgttacggtagttacgttaagttttaacgtcttaacgtacgtaacgttaacgtccgtacggtcggtccgggtccggttacccggggtcttaccggttccgggaaccgttcgggaacgttacgggtcaacgtacgtaaccgaaacggttcgtaggtacgtaccgttanaccgttacttaacgtccgtcgttacctacgtaccc

SEQ ID NO: 263214 - DNA, 761 bp, Homo sapiens
  misc_feature: GYAE6OF02I2X9F.8.33.C11.1.454.CMB.1.raw
  modified_base (107)..(107): a, c, t, g, unknown or other
  misc_feature (107)..(107): n is a, c, g, or t
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagctcgcgtgtccacgaccggtgctcgatttagagtgagctcgtgggagaggagcccagcactagaagtcggcggtgtttccattcggtgatcagcactgaacanagagactcaccagtggagtttgggctagaacgttgggttttcctcgttgtcttacgttttaaggaggttcgtcctgtgtcaagtgctacgtggtggagtcgtgggggagccgttagccaggccgtgggagtcaacgngtagtaccgtctcgtgtcgtcgtaacgtccgttcgttcggttccaccgttctaggtacncgtacgagtntcgacgtaccgtcgggtacctccctaaacgtccgacggacgaaagggttcgttaggacggtgggtacgtagtaggttttagtttaccgagtcgtgggaacggtcgtgttacggtataacgtgggtaactggtacgtcggacgttaccggagggaaccttcgtaacttccgaacgtacgtccgtaccgacgtacgtaacctaaccgacgtaaacgtaaccgtaccttagtacgtttaacgttaccggacctaacgaccgtaaccggttaacgtaaccttacgtaacggcgggttaaagcccgttagtaaccgtaacgttaaacggtaaggtaccgggaaggggaaccggtacggtaccgggaacggttacgtaacccgggttaaacgtccggttaccggtttacggaacccggtttcgggtaaccgggtaccggttaaacccgggtccg

SEQ ID NO: 263215 - DNA, 808 bp, Homo sapiens
  misc_feature: GYAE6OF02GCSXP.8.33.C11.1.454.CMB.1.raw
  modified_base (216)..(216): a, c, t, g, unknown or other
  misc_feature (216)..(216): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccctagtttcagactacccaccggagagattggtgttagacacagtcctccagccaccttgtctttgctccgaagggaacngccctacccgtctcctgccgaggaccagtcagagttggttcgccgtccttacggtaagcgtacggtaaccaacacctaaaccgtcggaccgaacgggtccttaccccgacgggtccccctatactacgtacgtcggtcgcctacgtacccgaaacgtaccgggccctaacggtcggacctacctaccccgacgtacccgtaggttccgtaggtcggaccgtagggtacgggtacggttacgggaacccgtaggttaacccttcgtaacccgtttcccgtaccgaccgttactacccgtagaccgtaaccggtccgtagggaccgtccgtaggaaccgttagtccgttacgtaccgtttaaggtttaccttaggtacgtaacgtaaccgttaccgtacgggttacccgtaagggttcccggtacccgggtaacccgggtacccggtttaacggttcccgggtacccggtaacgggttaaccgacggggttcggaacgtaacctaacggggtaaacccgaaggttttccgggaaccggtcccgtacgaccgtaaccggttactttccgaccggtttccgttacccgttacccgg

SEQ ID NO: 263216 - DNA, 769 bp, Homo sapiens
  misc_feature: GYAE6OF02GTOX4.8.33.C11.1.454.CMB.1.raw
  modified_base (213)..(213): a, c, t, g, unknown or other
  misc_feature (213)..(213): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagactaccaccggagagtattgtgttgaacacagtctccagccacctgttctttgtctccgagggaaanacgcccaccctctcctgcgacgggccaggtcaagtacgttggttcggccgtcttacgtaacgccgttacggtaaccaaacaaccgaaaccgtcggacccacggcctaccccgaccggcccctacgacttccgtagttcggtgaccactaccgaacggacgggcctaacggtcgtactacctacccgacgtcccggtaaggttccgaagggtcggacggtagggtagggtacggtacggggaacctaaggtaccgttacgaacttccctaccaaccgtactactacgtccgaacggtccgtaaacgggacctcgtaaggtaagtgttacgttacgtagtttaacgtttactacgttacgtaacctaacgtgttaccggtacgtcgggtacccgggtcccggtaccggttaccttaccgggttcccggtacggtaaccgggtaacgtacgggtaggtacctacggtaacccgggaaacttaccgggttcgggtacggttaacccgtccggtaccgtaccgtttacggttccgtttaacgttccttaccggttaccccg

SEQ ID NO: 263217 - DNA, 836 bp, Homo sapiens
  misc_feature: GYAE6OF02I1CZL.8.33.C11.1.454.CMB.1.raw
  modified_base (224)..(224): a, c, t, g, unknown or other
  misc_feature (224)..(224): n is a, c, g, or t
  modified_base (395)..(395): a, c, t, g, unknown or other
  misc_feature (395)..(395): n is a, c, g, or t
tcagctcgcgtgtccacgaccggtgctcgatttagagtgagctcgttgggtttggggaggaactgctcagttaggacccagagggaaccatggaagcccccagctcagcttctcttcctcctgctactctggcctccctagtttcagactacccgaccggagagtattggtgttcgacacaggtcctccagcccaccctgttcctttgtctccgaaggggaaanagcccaccctctcctgcacgggccagtcagtaatggttcggccgtccgttacggtaagtccgttacgggtaaaccccaaaccgaacctaaaacccggttcgggaccccgaagggtccccctacccccgaccggtacccccctttacgaactttccgttaacgtcggggttnaccctacgtaccccgaaaccgaccggggtcccaaccggtaggacctaacccgtccccacggtaccccgtaggtttcggaacgttcgggaccctagggttttcggggtaaggtcgggacctaacggttacttcccgaactttccccaacgtaaccctactcgtaaccgtaccgtaacggtcccgtaaggtccggtacccgtaagggtaacgtaggtttagggttacgtaccttaaggttttacttaccgttacggtaacctaacgtacgttacccggtaacgtggtaccccgggttcccgggttaccgggcccgtttaacggtttcccgggaacccgtagggtaacccgaagggtcgtaacgtacgtaaccggtaaacggtaccgttacgggtcgtacctacgtacccgtctacgttacccgttgttacctaccttaacccg

SEQ ID NO: 263218 - DNA, 734 bp, Homo sapiens
  misc_feature: GYAE6OF02H8OW5.8.33.C11.1.454.CMB.1.raw
  modified_base (446)..(446): a, c, t, g, unknown or other
  misc_feature (446)..(446): n is a, c, g, or t
tcagctcgcgtgtccacgaccggtgctcgatttagagtgagctcgttgggtttgggggaggaactgctcagttaggacccagagggaacatggaagccccagctcagcttctcttcctcctgctactctggctcccagtttcagataccaccggagagattgtgttgacacagtcctccagcccaccctgttcctttgtctccgaggggaaagagccacccctctcctgcgagggccagtcgagagtcgttacccacctagttacgccttggtaaccaacaacctaaaccgtcggaccgaggcctaccccgacggtccccctacactctttgatcgcactccatcgacggcccacgtcggaccacacccacgaccgtaggttacgtaggtcggacgtaggttcggggtacgtggggacaggtaccttcgacttaccgtacaacccncttaccgacgacgtacgtcccgtaagccgtactaaggttaattacgtttacgatttaaggtttacgttaacctagttaacaacttacgttaccggtaaccggaggttcccggggacccgggtttacccggggaccccgtttaccggtttacccggggtaccccgttaacggggaaaccctaaagtttcggaaccgtaacgttaacccggtaaacgcggttacggtggtacccggttacgaccctacgtacgttaccctttcggttacctttacccgtagtttcccccg

SEQ ID NO: 263219 - DNA, 811 bp, Homo sapiens
  misc_feature: GYAE6OF02JO5YG.8.33.C11.1.454.CMB.1.raw
  modified_base (228)..(228): a, c, t, g, unknown or other
  misc_feature (228)..(228): n is a, c, g, or t
  modified_base (787)..(787): a, c, t, g, unknown or other
  misc_feature (787)..(787): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagtactaacccgaccggagagtattgtgttgacacagtcctccacgccctaccctgttctttagtcctaccggaaggggaaacncgcccacccttcctccgtgacgacgggcccagtaccaggtaattggttcggccgtccgttacggtaaacgtccgttacggtaaccaaccaaccgaaacccgtcgggacccacggccctaccccgaccggtcccctacacgttcctagtcgggtaccacacgtaccgaacgaccgggaccacgtacgcctaaccgtcccgacgtaccgtacggtcgtacggtcggacgtacgggtgggtacggtacggaccgtaacggtaccttacctacgtacccgtaccgtaaccctagtaccgtactaaccggccgtaccgggtaacgtaccggtaccgttaaagggaacttacggttaacggtacttaccggtttaaaggttttaccctttaccgggaactttaaccggtaaactccgttaaccgggttaacgtacgggtcccggtaccccgggttaccgggtcccgttaaccgggtttcccggccccggtaaggggtaacccgtaaggggcgttacgacgtaacccggtaaacgtcggtagggtccacgtactacctacccggtntccggttaccttaccgtacctccg

SEQ ID NO: 263220 - DNA, 733 bp, Homo sapiens
  misc_feature: GYAE6OF02FH751.8.33.C11.1.454.CMB.1.raw
  modified_base (215)..(215): a, c, t, g, unknown or other
  misc_feature (215)..(215): n is a, c, g, or t
  modified_base (728)..(728): a, c, t, g, unknown or other
  misc_feature (728)..(728): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgactacagtcctccagcccaccgtgtctttcgtctaccgaggggaaancgcccacccgtacgtcctgccgagggccagtccgagaactggttacggcgtccttacggtacgtacgtacggtaaccaacgaaccgaaaccgttcgggcccacgggcccttaccccgaacgggtcccccctacgacttcctaacgtcgggtactactaacgtaaccgaaaccgacggtacccgtacgtacggacctacgttacccgaccgtaccgtaacggttaccgacggttccgggacttacgggtaacggtacgtaggggaacccgtaagtacccgttacaacccgtttacctaaccgtaccctaatacccgataaccgtacggtcccgtagggtaccgtaccgtaggaacgtacgtcgtacgtacgttaacggtttactaccgttacgtaaccaacgtacgtacgaaccgttagtcggtaccgccggggtacctacggttcccgcgtacggacgtacggagtacacgtacgaacgctagtcgacgtacgacgactagtacgtctacgtntaccg

SEQ ID NO: 263221 - DNA, 946 bp, Homo sapiens
  misc_feature: GYAE6OF02H8LV5.8.33.C11.1.454.CMB.1.raw
tcagctcgcgtgtccacgaccggtgctcgattttagagtgagctcgtgggagaggagcccagcactagaagtcgtcggtgtttccattcggtgatcagcactgaacacagacggactcaccagtggtagtttgggctgaacgttcggggtttttccctgttgtcttacgtttttaagaggtcgtcctaggtgtacaagtgcaacgtggtggtagtcggtagggggacggtacgtaacggtcccgaaggtcccgttgggggaaggttccaaccgaaggtacgtaaccttccgttccgtaggttcgacctacgtccccgtttacggtacgggtttttcccaaccccgttttaggaaccggttaacgaccggttaacccgggataaccgtttcggaaccccgttaacggttccgggggttaaccccaaacctaaaccccgttaccggaacgggtaaccggtaaaacgggggttaacgtttcggggttaaagggtcccgggggttagtacggttttaacggtttccggtttttacaacgttccgggtaaaggcggggtaccttaaggtttacgtttaaccgaagtttcggggtaatccggtaccgtacggtacccgtacggtacggtaaaccggggtcccttaagtttaccgacctaacgtccttaaccggagtaacggaaaccctaacgtacccgaaaggtaacctaagtaacgttacgttttacgtaggaacccttaggaacgtaaccgttaccgtaagttacccgtaggaacgtaccggtacgggttaactacgtaaacgttaaccgtagggaaaccgggaacggggaccggggttaaaccgacgggttaccgggttaacggtacccggtttaaacgtacccggtttccggttaaacgggtaccgggttaccgggttacccgggtaccggttaccggttaaccccgg

SEQ ID NO: 263222 - DNA, 738 bp, Homo sapiens
  misc_feature: GYAE6OF02HLTKY.8.33.C11.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgcctactctggctcccagtttcagactaccgaccggagagtattggtgttgacacagtctccagccctaccgtgtcttgtctccgaagggaancgcccacctctccngcnggtccagtcagatgtgctctgtagctacgaccaacacaacgcgcncgctccgacgccctcntcgtatggctacnctaccacgacggcacgtcgacacgtaccacgtaccgtacggttcacggtcggacgtaggttacgggtacggttgggaaaccgtaacggtaccgtcctaacgttacccgtcctaacccgaatttaccagtaccgccgtaccgtagggacgtacccgtaagggaacgtagttcgttagttacgttacggtttaattacctacgtacgtaaactacggttaccggttaagccgggttccggggtacccgtcccggggtacccgtttacccggttcccgggtacccggtacccgggtaaacgggttaaccgggtaccgggtacgtaaccgtaaccggtaaaccggttaacccggtacggggttaggtaaccccgtcggttaacccgaaccggttacttacccggtttacggtttaaccttcccgttttaaccccgg

SEQ ID NO: 263223 - DNA, 882 bp, Homo sapiens
  misc_feature: GYAE6OF02H4BIM.8.33.C11.1.454.CMB.1.raw
  modified_base (163)..(163): a, c, t, g, unknown or other
  misc_feature (163)..(163): n is a, c, g, or t
tcagctcgcgtgtccacgaccggtgctcgatttagagtgagctcggttgggtttggggtctgggagaggagcccagcactagaagtcggcggtgtttccattcggtgatcagcactgaacacagaggactcacatggagttgggctgaacgttgggttttccncggttgctttacgtttttaaggaggtttcgtaccgaggttgtacaaggtcgacaaacgttgggtggaggttcggtcggggggaagcggttagtccaggtccgttggggacgtcacgagacgactcgtccgtggacgctacggccgttacggttcgggttaccctacccgttgtaacgacggtccgtaccggactgcgtaccgtcggtaccgggttaccccaaccgtaaaccgttccgaacggacgtaacgggtagtttagggaggttcggggagtcttacggtttcgttacacccggttggacggtacggggtctaacggtttccgtttaagtaacggtagttgtaccgggtcgtaacgggtaccccgggtaggttaacgggtaacccggggtaccgtttaacgttacccggtacccgttaaaccgttacccggtaacccgttaaagggaaccgtaacccgaacccgttaaccgggaaaacgtaaaacgtaacccgttaaaggttcgttaaccggtttcggaaacccttacggtaaacccggtaaccgtacccgtttaacgtaaccggtacgtacgggttaaccggtaacgggttacttacgttaaccgttcgtaacgggtaacgggtaacgggggacccgggtaagaacccggtacggttaccgttaacgaacggtttaccggtacccgtttaaggtacccggtagggtaaccccggg

SEQ ID NO: 263224 - DNA, 819 bp, Homo sapiens
  misc_feature: GYAE6OF02I969Q.8.33.C11.1.454.CMB.1.raw
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttggctgaactgggtttcctgtgctctttaagagtgtccagtgtcaagtgcaagtggtggagtcgtgggggagcgtagtccaggccgtgggacggtccacgagagtacctcctccgtggtcgactacggccttcggttcgggttacacccctttcgacggttagaccgtaacgggtcagttacggactaccggttcggggtacccgaaccccgtaaaaccgtcccgaagggacctaaagggggtacgttggggtaaggtgggggttaggctaagggttttgttttaccaggttccgtaggaacgggtctaacggttgttacgaagttcggtaatcgtacgtggaaccccgtggtacgggtaagggcccgtacgttaccgtaaccacgtacccgttaccgaacgaacgtaacccgtaaaccgtacccggaaacgtaaaccgtaaacgtaacgttacggtttaacgttacgaacccgttaacgaaactaccggtaaccgtaccgttacccgtaaggaaccgggtaaacgtacgggggttaactaacgtttaccgtacgttaaggtaaccgggtaaacggggaaaccggggtaccggaacggggttacgggtaaccgggttacccgttaaaccggttaccgtttacccggtttaccggtaccggttagggttaacccggggg

SEQ ID NO: 263225 - DNA, 679 bp, Homo sapiens
  misc_feature: GYAE6OF02JOLSF.8.33.C11.1.454.CMB.1.raw
  modified_base (159)..(159): a, c, t, g, unknown or other
  misc_feature (159)..(159): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (415)..(415): a, c, t, g, unknown or other
  misc_feature (415)..(415): n is a, c, g, or t
tcagctcgcgtgtccacgaccggtgctcgatttagagtgagctcgttgggtttggggaggaactgctcagttaggacccagagggaaccatggaagccccagctcagcttctcttcctcctgctactctggctcccagtttccagatacccacggaganattcgtgttgaacgacagtcctccagtcccacctgttctttgcctcgagggaaaancgcctacctcnccgtgcaggcagtacagtatgttcgcgtaccttaganctcggaccacgacaccgtgccaggtccctcgacggtccctacatccgttagcggtacgtctaacgtaccaacggtcggacctacggttggcctaacgtcccgaacgccgttaggtaccgaggtcgcgaggtttacggaagtagggtaacccngttacttcgaccgtctcgaacccttagtaccctagtaccaggtcccgtagtaccgtcttaaacgggtaataacgttggttaccgtaatttaagttactacgtacgttaactacgtacgtaccgtacgtcgtaccggtcccggtaccgggtaccttacgttccgtaccgtacccgggacgtaggtacgttacgaactaccggtaaagacccgttagggtacctacgtccgaccgtacgttaccggtctacgtccgttactacccg

SEQ ID NO: 263226 - DNA, 798 bp, Homo sapiens
  misc_feature: GYAE6OF02GCBQY.8.33.C11.1.454.CMB.1.raw
  modified_base (205)..(205): a, c, t, g, unknown or other
  misc_feature (205)..(205): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgttgacacagtctcagccacctgtctttgactccagggaaancgccacctctctgcagggccagtcagtaactggtttacggcgtcctttacggaaagtcctacgggtaacccaaacgaacctaaaaaccgtcgggacccaagggtccttaccccgaacgggtcccccctacaacgttcctaagttgggtacgacgtaactacccgtaaaacggacggggtacccctaacgtacgggacctaaacgttccccgaacggtaccccgtaaggggttccaacgggttggaccgtaggggtttagggtagttacggggactacggtaaccttacaacgtcctacacctaatccgatacgacgccgtagggaaccgtaccggtgaaaacgttcgttacggttacgacgttacgttttaaacgttacgttaccggtaacctaaaccgttaacgttaccggtaaccgtacgggtccggtacccggtcccgggggtacctttacccggtttaccggggacccgttacgggtaaacgacgggttaggacgttaaacttacggaaaaccgttaacgttccgggtaagggtaccttcgggaacccttaaccggaccgtttacggtccggtttaccttataaccccg

SEQ ID NO: 263227 - DNA, 630 bp, Homo sapiens
  misc_feature: GYAE6OF02G6YF9.8.33.C11.1.454.CMB.1.raw
  modified_base (147)..(147): a, c, t, g, unknown or other
  misc_feature (147)..(147): n is a, c, g, or t
  modified_base (164)..(164): a, c, t, g, unknown or other
  misc_feature (164)..(164): n is a, c, g, or t
  modified_base (281)..(282): a, c, t, g, unknown or other
  misc_feature (281)..(282): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
tcagctcgcgtgtccacgaccggtgctcgatttagagtgagctcgtgggagaggagcccagcactagaagtcggcgtgtttccattcggtgatcagcactgaacacgagaggactcaccatggagtttggctgaactgggttttccncgttgctacttttaagnggtgtccagtgtcaagtgcaactggtggagtcgtgggggacgtcgtagtccagcctgggagtcacagagtactctccgtgtgcagcctcgtggttccaccttgagtagccgtacggnngtacgcaacgtcgggcccaccaagtccgaggcaagggtatgggagtggggtnacgtagttnttcagtcctggaggctaggtctacgaagtggtntggtaccgtagccgtccggtaggaaccggtcctagttccgacgtactccgtacagtacgacctacgtaccaaggtaacaggtaatggtatttacgctagacacgactacgtacctaggaccgacgtagggtctaactaccgtcgtacgggtacggacggggaacgggaactcggggacggtaaccgtaccgtaacgttaccgttaccggttacggaacccggttgggtaccggtaccggtaccggttaccccgg

SEQ ID NO: 263228 - DNA, 921 bp, Homo sapiens
  misc_feature: GYAE6OF02FZP3Y.8.33.C11.1.454.CMB.1.raw
  modified_base (109)..(109): a, c, t, g, unknown or other
  misc_feature (109)..(109): n is a, c, g, or t
  modified_base (157)..(157): a, c, t, g, unknown or other
  misc_feature (157)..(157): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
  modified_base (569)..(569): a, c, t, g, unknown or other
  misc_feature (569)..(569): n is a, c, g, or t
tcagctcgcgtgtccacgaccggtgctcgatttagagtgagctcgtgggagaggacgcccagcactagaagtcggcggttgtttccattcggtgatcagcactgaacanagagtactcaccagtggtaggtttggctagtacgttcgggtttttccncggtttgtcttacgttttaaggaggttcgtacctagttgtactaaggtcactaacggtgggtaggngttgggtaggggggagtccgtagtccgagccggtagggtacggtacaacgngaacgttccctcttcgtgtcggaacctccggtcctttcggttaccggttaccctacccgttacgtaaaccgttaaccgtaccgggacttacgcggtaccgttacccggttaccgggtccccgaaccggttaaccgaccccggttcccggggaaccggtaccggggtaaaggggttaccggttttaggggggaccgggtttcgggggttacggtaacggtttcggtttttcgtttaacttcggttaccgggtcgggacgggttgtaccggtttaggtaccgttaggttaagggttntacggtaacctcgggtaaccgtacggggacggttaaccgggtccttaacgtacccgtaccgtacttaccgtacgaacgtacgtaaactaccgtaacgaacgtaaacaacgttaagttaggttaacgtaggtcctaggaacttaacggtacccgttacgaaccgttacggtaacggtaacggtaccggtaacgttaccgtaacggttaacctacggggttaacgaacggggtaaccggggaacggggtaacggaccgggttaaacggtaccgggttaaccgtttaaacggtttcccgttaacggtttaccgggtccgggttaccgggtccgggttaccccgttaacccggggg

SEQ ID NO: 263229 - DNA, 837 bp, Homo sapiens
  misc_feature: GYAE6OF02FN8M3.8.33.C11.1.454.CMB.1.raw
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
tcagctcgcgtgtccacgaccggtgctcgatttagagtgagctcgttgggtttggggtctgggagaggagcccagcactagaagtcggcggtgtttccattcggtgatcagcactgaacacagaggactcaccatggagtttgggctgaactgggttttcctcgttgcttcttttaagaggtgtccagtgtcagtgcaactggtggagtcgtgggggagcgtagtccagcctgggagtcacagagactctccgtgtgcagcctcgtgggttcaccttnagtagctacggcatcgcacgtcgggtccaccaactccgaggcgaagggtnttcgggagttgggtggctaggtttgtttcacgtcgtggaggggtctaggtcgtttacaagttggtaattcggcttagggacccggtccggtagggtaaccggggcccgttaagttcccgaaccgtacgtttacccgttaccgaaacgggtaccggtaaacctaacccggtacccggtaaaacgggaaccctaaacgtaaacggtttacggtttaaacggttttaccgggtaacccgttaacgggtaaacctaacgggtaccccttaaaggggttaccccttacggggaaaccgggttaaccgggtaaccgggggtttaaccgtttaaaccgttaaccggttacggttaaccgggttaaacgggggtaaaccgggggggtaaacggggggtaaaccccgtaacggggttaacccgggggttaacggttaaccccgggtaaacggtttaaacccggttttcccgggtttaacgggttaacccgggttccggggtttaaaccccgggggggg

SEQ ID NO: 263230 - DNA, 858 bp, Homo sapiens
  misc_feature: GYAE6OF02IPOCJ.8.33.C11.1.454.CMB.1.raw
  modified_base (63)..(63): a, c, t, g, unknown or other
  misc_feature (63)..(63): n is a, c, g, or t
  modified_base (276)..(276): a, c, t, g, unknown or other
  misc_feature (276)..(276): n is a, c, g, or t
  modified_base (617)..(617): a, c, t, g, unknown or other
  misc_feature (617)..(617): n is a, c, g, or t
tcagctcgcgtgtccacgaccggtgctcgatttagagtgagctcgttgggtctgggagaggancccagcactagaagtcggcggtgtttccattcgtgatcagcactgaacacagacggactcaaccatggagtttggctgaacttgggttttcctcgttgcttacgttttaagaggttgtccagtgtactaagtgctaaacgtgtggtagtcggtagggggacgtgtacggtaccagtccgtgggagtacgacgagacgtaccttcctctggtcncacgtccgtttcgtcgggttcctacccttacgtacgtacggacctacggacctataaccgtaccggttacgggttacccctaccgtaaacccgttcggaacgggtaccgtaaggggtatttacgggacggttcgggtaggtaccgtaggtttcgttacagttcggtacgagtaacgtgtacggttagactaggtactcggaccgtagggcgtacggtaacggacgggtacgtaacgttacccaacggactttccgaaacggacgttaaccgaactacccgggtacgtaaaccgaactaaccggttattaagggttaccttaaccgtaacgtcgtaaaaccncgttaaacccggttagtaccgtttaacgggaccgggttaaggttaccggggttaaacttaacccggtttaaaacgtacccggtaaacggggttaaggggggtaaacccgggggtttaaccggaagggtttaacccggggtaacgggtaccctttaacggttaaacggtaccgttttttaaccggtttacccggacggggttttaaaccggggtccggggtttaacccgttaccccgggggg

SEQ ID NO: 263231 - DNA, 766 bp, Homo sapiens
  misc_feature: GYAE6OF02G5TFY.8.33.C11.1.454.CMB.1.raw
  modified_base (180)..(180): a, c, t, g, unknown or other
  misc_feature (180)..(180): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
  modified_base (384)..(384): a, c, t, g, unknown or other
  misc_feature (384)..(384): n is a, c, g, or t
tcagctcgcgtgtccacgaccggtgctcgatttagagtgagctcgttggggtttgggggaggaactgctcagttaggacccagagggaaccatggaacgccccagctcagcttctcttcctcctgtctactctggcctcctagtttcagatacccgaccggagagtattggtgttgacanagtcctcacgcctaccttgtctttgtctacgaggggaancgcctacctctcngcgacgggcctagtacaagattcggtggctccttagacgtcgtacggtaccaacaacaacgtcgccgagcctaccgcgccctcgtatctagtgtacnctacgtaccgaacggcggtccacgtgcctacgtccgagccgtagttcaggtcggngtagggtgggtacgtacgggactactacttacgtaccgttcacgacctactacgtaacctcggactccgggtaagccgtacgtaaggagtttacgtacgggtttcgtacgtttaacgtttaacgttacgttaaccacgtttaaacggccgtttaaccgggaccgtaacggggttcccgggaccccgggtttaccgggttacccccggttaccgggtttacccggtacccgggttaacgggaaacccggttacggggttaacgggaccggtttaccgttaaaacccgggtaaacggtacccggtttaggggaccgttacccgacgttaacccttaacccggttagtttccccggttaccggtttaccttaccccggtttaccc

SEQ ID NO: 263232 - DNA, 730 bp, Homo sapiens
  misc_feature: GYAE6OF02I7DVX.8.33.C11.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctgctcccagtttcagataccaccggagagattgtgttgacanagtctccagccaccctgtctttgtctcgagggaanagccacctctcctgcgtagggccagtcagaatggttggcgtcttcgtaagctaggtaccaacacaacctggaccaggcctccacggcccctacnctctatggtcnctactaccaacgacggccacgtcgactacgtcccagtcccgagttaccaggtcggcgtacggtagggtacgtcgggaacgtaggtaactaccgtaactctaccgtaaccacgtaccaacgtccgaacgtccggtaggaaccggtcggtacggtaaagtagttgttcgtacgtttgtttaaacttcgttagtaaccgtaccttaacgtaccgggttaccggtaacgggtccggtacccggggtttacccggggtacccgttacccggtttccccgggtaccgggtaccgggtaacccggtaggggttaacggacccggtaacgtaacccggtaaaaccggtaaccgtttcggggaacgttacccgtaacggtacccgtaacggttaacccttcggtaactttcccgtaacctttacccgg

SEQ ID NO: 263233 - DNA, 696 bp, Homo sapiens
  misc_feature: GYAE6OF02GN3ZI.8.33.C11.1.454.CMB.1.raw
  modified_base (270)..(270): a, c, t, g, unknown or other
  misc_feature (270)..(270): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagctcgtgggttccaccttnagtagctacggcagtgcactgggtcccaccaaacgtccaggtacaagggtattgggacgtgggtcgcgtaggtttgtttccagtccgtggtacgggctagtcgttacaagttcggtatggactggacgtccggtaggaacggtccgagttccactaacgtccgttacaacggagtaacctaacgtacccgaacgggtaaccactaaacgttggttaacgtttcggaacccttgaaacccgtagtacccgttaaaggtccttagggacggtaaccgtaacggggtacgttaacttaccgttaacgttaggtaaccgggtaacggggtaaacggggggtaacccaggggtaaccgggtacggtttaccgtaaacggtttaccgttaccgttaacgggtaccggttacggtacgggggttaaccccggg

SEQ ID NO: 263234 - DNA, 826 bp, Homo sapiens
  misc_feature: GYAE6OF02GQ5IO.8.33.C11.1.454.CMB.1.raw
tcagctcgcgtgtccacgaccggtgctcgatttagagtgagctcgtgggagaggacgcccagcactagaagtcggcggtgtttccattcggtgatcagcactgaacacagaggactcaccaatggtagtttgggactggtaaccttgggtttttccctcgggttatccgtttactttttaaaggacggttcggtaccctaaggttcgtaccgaaagttcgaccgtaaacgttggggttacggaacgttccggtaggggggtacggtaccggttacgttacccgacggtcccgttagggggacggttaccaacgaggaccgtaccttaccgtccgtggtcgactacggtaccgtccgttcgggtttaccctacccgtttagaacgttacggtaccttaccggactagtacgaccgtaaccggttcgggtacccgtacccaaaccgtccgaaggacgtaacgggttacttacgggagttcggggtagccgttaagttttgttttaccgagttcggtacggtcggtactaggttacgttaagaggttaacggtttactacgggttcagggtaacccgtaggtacgtaacggggtcctaacgttccgaaccctacgtccgtacgaaccggtacaaaccgtacgaccgaaacgtaacccaagttacacggtttacgtacgtaacgacgtaaacgaccgttacgtacgtcgtaggacgtaccggacgtttacagttaactcgtagtaacgggacgggtacggtagacggttacggacgtaccgaacgttactacccggttgaccgttccggtacgggtacctacgggtcccg

SEQ ID NO: 263235 - DNA, 787 bp, Homo sapiens
  misc_feature: GYAE6OF02FOUDU.8.33.C11.1.454.CMB.1.raw
  modified_base (517)..(517): a, c, t, g, unknown or other
  misc_feature (517)..(517): n is a, c, g, or t
  modified_base (550)..(550): a, c, t, g, unknown or other
  misc_feature (550)..(550): n is a, c, g, or t
  modified_base (581)..(581): a, c, t, g, unknown or other
  misc_feature (581)..(581): n is a, c, g, or t
  modified_base (618)..(618): a, c, t, g, unknown or other
  misc_feature (618)..(618): n is a, c, g, or t
tcagctcgcgtgtccacgaccggtgctcgatttagagtgagctcgtgggagaggagcccagcactagaagtcggcggtgtttccattcggtgatcagcactgaacacagagtactcaccatgagtttggctgtaactgggttttcccgttgcttagtttaagaggtgtccagtgttcaaggtgacaacgttgggtacggagtcggtgggggaacgtcgtaacgtccaggtcccgtagggacggtacaacgtaggaacgtccttcctaccgtggtacgccgtacggtccgtccggtttcgggttaaccctacccgtttaggaacggttaccgttaccgtaaccgggtcttacggtacgtaccgtaccgtttcggggggacccccctaacccgaaaacgttccccggtacgggaacgtaaacgggggtattttaccggggagggtttacggggtgaccgttaggtttcgtttacaggtacttcggggaagtcctaaaggttctagtaacgtcggtttanacgtcggtacgacggtcgaaggaacgtccttancggaacctcgtaccacgagacgaccgttacncgaagtacgaactaggttatccgtagactacgtaacncggttaactacgtacgaggtacgtaacgtaccggtacttaacgacggttaaccgtaggttaaccgggaacggggacggttaacggaccggtacggttaaacggtacgttaaccggttaccgttccggtaacggtcgtttaccgggacgggtttccgaacgggttccccg

SEQ ID NO: 263236 - DNA, 810 bp, Homo sapiens
  misc_feature: GYAE6OF02FID3W.8.33.C11.1.454.CMB.1.raw
  modified_base (211)..(211): a, c, t, g, unknown or other
  misc_feature (211)..(211): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctccctagtttcagataccaccggagagattgtgttgacacagtcctccagccacctgttctttagctcgagggaacngccaccctctacctgccgtacgggcctaggtccagtaactgttcggccgtccttacggtagtcctggtaacccaacgacctaaaccgtcggtccacggtcctccccgacggtcccctcgtacctcgtaacgtcgggtactccaactaccaacgcgggacctacggtcgacacttacccgtacgcccggttaagttacacgggttcgcggtagggttcgggtacgtaggggacctaacggttccttacgacccgtttacctaccgacctaacgtactaacgtacgtacgtaccccggtaggtaaccgtccgtaaggtaaacgttacggttcgttacggaacgtttacggttttaaactcgttaacggttaacctaaccggtacttacccgggtacgtaacggggtcccggtacccgggtacccggggtaacctttcccggggtttaacccggaccgtttacccggggaacgggttacgtaaccggggtacgtaaccggtaacccggtaaaacggtaccgggttaccggtacgggttacctaacccggtcccttaaccgtaaccgttacggtttacgtttcccgtaacccgtttaacccgg

SEQ ID NO: 263237 - DNA, 706 bp, Homo sapiens
  misc_feature: GYAE6OF02GNJXA.8.33.C11.1.454.CMB.1.raw
  modified_base (391)..(391): a, c, t, g, unknown or other
  misc_feature (391)..(391): n is a, c, g, or t
tcagctcgcgtgtccacgaccggtgctcgatttagagtgagctcgtgggagaggagcccagcactagaagtcggcggtgtttccattcggtgatcagcactgaacacagaggactcaccatggagtttgggctgaacgttgggttttcctcgttgcttacttttaagaggtgtccagtgtacaagtgctagttggtggagtcgtgggggagcgtggtccagccgtgggacgtccctgacgtacctctcctgtgcacgtcctcgtggtacttccaccgttcgagtacgctagtcgaactagtcgctacggttcgggtacccgaccgaggccctaccggaggtaccgtaacggggttcgtagggaggttcggggtacgtacttaagttttaanacttcgtaagttaagtaggtaacggttagggtaaacgttaaagtacgtaaaacgttacgtaagtcgacgtacggtacccgtccgggtaaggaaccgggtccctaacgttcccaacctacgtaccctaccggaaagtaaccgtaaaccttaaacggttacccaaaggaaaccgtacgtacttaccgttataccgtagaaaccttaaagtccgaaccgtacgtactaagggactaacgtggaacgacgtcgttatggttagttacgttggtaggggaacgggtaacgctaggtcgaagtaggtacgtactacgtacg

SEQ ID NO: 263238 - DNA, 685 bp, Homo sapiens
  misc_feature: GYAE6OF02F1JMY.8.33.C11.1.454.CMB.1.raw
tcagctcgcgtgtccacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgctaacgtggtggagtcgtgggggagcgtagtccagccgtgggacgtcacagatactctcctgtgcacgccgtcgtaggttcctaccttcgagtacgcctacggctatcgacacggttcgggtcccaaccgtaacctccgagggacgaagggtagttgggagggttcgggtggaccttaggtttcgtttaccagttcggtaggacggggtctaggttacgtactaagtactactaacgacgtaccgtaccggtagggaaccggtccgtacttcctaacgtacttaccgtaaccgaagtaacgtaacgtaaacgttaccgaaacgaaacctacgtaagttacgtaactcctagaacgtaagtcggaaccacgtactaaagtacgtaggacggactacggttagttagttaatacgtaggtaaaccggtaaaggggtacgggtaataacggtagggtacgacgtacggtactaccggtaacgttaccgttacgttaacg

SEQ ID NO: 263239 - DNA, 955 bp, Homo sapiens
  misc_feature: GYAE6OF02HL9KO.8.33.C11.1.454.CMB.1.raw
  modified_base (750)..(750): a, c, t, g, unknown or other
  misc_feature (750)..(750): n is a, c, g, or t
  modified_base (915)..(915): a, c, t, g, unknown or other
  misc_feature (915)..(915): n is a, c, g, or t
tcagctcgcgtgtccacgaccggtgctcgatttagagtgagctcggttgggtttgggggaggaactgctcagttaggacccagagggaaccatggaagccccagctcagcttctccttcctcctgctactctggcctccctagtttacaggtactaacccgaccggagagtatttggtgttgactacgtagtcctcccgacgacccctaccctcggtttcctttggtccctaacccgggaaaggggaaaacgccgaaccccgtccccctttcccgttacctcggaccgaccgggggccctaacgggtttaccgaaacgttaaacgttttccggggttacccgggtacccggttttaaccccggttttaacgggtaaaccgggttccgttaaccggggttaaaaccccctaaaacccgtaaaccccgtaaaccccggttacgggggaccccggtaacccggttacccccttacccccgggaaacccggggttcccccccttccgtaaaccggtttaccgttaacggttcgggggtaccctaacccgtaaccccgaaaccccgtaaacggggaaccccgggggtacccccgttaacgggttacgggacccgttaaccccgtaccccggtaaccgggtaaccgtacgggttacgtcgggtacggaccggtagggttcgggttaacggacgggtaacgacttaccgtacaccgttcaaccgtacgtactgacctacgacgcgtcggactacggngtagtacgtacgtacgttgtagtttcttacgttccgaaacttacacgtaccgttaggtaccggtaccggtccgggtccgtacccggtacggttacccgtcggtacggaccggtacggtacggacgtacggtaaacgtacgtacgttccggtaacgtccgacccgngttaccgaccgttccggtaacggtttctacccggttcccg

SEQ ID NO: 263240 - DNA, 826 bp, Homo sapiens
  misc_feature: GYAE6OF02FSSWA.8.33.C11.1.454.CMB.1.raw
  modified_base (316)..(316): a, c, t, g, unknown or other
  misc_feature (316)..(316): n is a, c, g, or t
  modified_base (559)..(559): a, c, t, g, unknown or other
  misc_feature (559)..(559): n is a, c, g, or t
  modified_base (793)..(793): a, c, t, g, unknown or other
  misc_feature (793)..(793): n is a, c, g, or t
tcagctcgcgtgtccacgaccggtgctcgatttagagtgagctcgttgggtctgggagaggagcccagcactagaagtcggcggtgtttccattcggtgatcagcactgaacacagaggactcaccagtggagtttggctagaactgggttttcctcgttgctcttttaaggaggtgtccagtgtcaagtgcaactggtggagtcgtgggggagtcgtagtccagtccgtgggaggtcaacgaggagtactccgtccgtagtcgcgtacgtccctcggttcggttactacccgttcaaggtacgtacgtaccggancgtcgcgtacggttcgggtacccgacccgtaaaccgtccgaacgggtaccgaaaggggtctttaggggaggttcgggggtacggtaccgtaggttcgtaccttacgtacgttcggtacggtaacgggtcttacggttacgtttaacgttacggtttagttacgttcgtacgtaaccgggttaccggacggttaaccggggacgttaccgttaaccgtacctaaaccgacccgtttaccgtaanaaccggtaaacgtacccgtaaacccggtaacggtaaacccaacgtaaacggtttacggtttacgtttaacggtaaccggtacccgttaaggaaacccgtaaggttaccccgttacgttacggaacgggtaacgttacccggttaaagtacgtaaacccgttagtacgtaaacgggtaccggggaaagggtaacccgggtaacgcgggtaacgtaaccggttactaaccgggttnttaacccggtttggtacccggaggttacccggg

SEQ ID NO: 263241 - DNA, 902 bp, Homo sapiens
  misc_feature: GYAE6OF02G5K9E.8.33.C11.1.454.CMB.1.raw
  modified_base (452)..(452): a, c, t, g, unknown or other
  misc_feature (452)..(452): n is a, c, g, or t
  modified_base (856)..(856): a, c, t, g, unknown or other
  misc_feature (856)..(856): n is a, c, g, or t
tcagctcgcgtgtccacgaccggtgctcgatttagagtgagctcgttggggtttggggggaggaactgctcagttaggacccagagggaaccatggaagccccagctcagctctcttcctcctgctactctggctcccagtttcagataccaccggagagattgtggttcgacacagttcctaccacgccctacccgtgttccttttggtacctcccggaagggggaaacaccgtaccccgacccttcctaccgtcggaccgacggggtccctagtaccgaagtaacgttgttcgggaccgttccgtttacggtaacgtccgttacggtaacccaaccaacgtaaaacccgtcggacccgaaggggtccctaccccggaccgggtccccttacgactccgttaacgtgggtcactacgtacccgaacggtcgggaccacgttcggcctaccncccgaggtacccgtgggtacctacgggtcggacgttaggggtagggttaacgttaccggggaacgtacgtttaaccgttaccgtacgttacccgtaaccctaacccgttacgtaaccgtaccttccggtaccgtcccggtaggtaaccgccccgggttaaagaacggtactttccgggtaacgtccgggtttaaagtttttacttaccgggtacgttaccgtaaaacccgttgggttacccctaaaccggggtcgggtacccgggttaccccggggttacccggggttacccttaccgggttttcccggggaaccgggttacccggggaaagtttaccggggttcgggaaccgttactaaaccccgggggtaaactagggttcggtaacccggttggtaacccncgtttaccgaaaccgttccgtttagtccccgtttaccgtaaccccg

SEQ ID NO: 263242 - DNA, 874 bp, Homo sapiens
  misc_feature: GYAE6OF02GQEHY.8.33.C11.1.454.CMB.1.raw
  modified_base (150)..(150): a, c, t, g, unknown or other
  misc_feature (150)..(150): n is a, c, g, or t
tcagctcgcgtgtccacgaccggtgctcgatttagagtgagctcgtgggaggaggacgcccagcactagaagtcggcggttgtttccagttcggtgatcagcactgaacacagaggctcacatggtagtttggctgacttgggttttccncgttgacttcgttttaagaggtgtccagttgtacgaagtgactaacggtgggtaggagtcggtagggggacgtcggttacgtccgagtccgtgggacgtcacgaggatacctctcctgtcgctacgccgtcgttcgggtcctaacccgttgaacgtacgtccgtaccggcagtcgcgtacgtcggacccgaccaaacgtccgacggacgtaagggtacgtgggtacggtagggtcgtacggtggttttacgttactacgttacgtacgggtaaggtcggtttagtggttttaaacgtaaaggttgggtttaaacgtggtaccgtacggggaacccggttacccgggttaaagggggtaaacccgggttcccgggtttaaacttacccggtaacccgtttaaccggtttacccgtaacccgggaaagtttaacccggaaaccctaaaccgggttaccggaaaacggtaaccctaagttaagttacggtttacgtttacggtaaacccgtaaagtaaccacgttaacccgtaaggttaccgtacggaaccgggtaacggtaaccgggtttataaccgtttaaaccggtaacgttaccggaaaggggttaaccggggaaccggggttaaccggaagggttaacccgggtacttaaaccgttacggtttaaccttcggttaacggtccggttaccggggtacgggtacccgtaacggtttaccccggg

SEQ ID NO: 263243 - DNA, 813 bp, Homo sapiens
  misc_feature: GYAE6OF02GOHEY.8.33.C11.1.454.CMB.1.raw
tcagctcgcgtgtccacgaccggtgctcgatttagagtgagctcgttgggtttgggggaggaactgctcagttaggacccagagggaaccatggaagccccagctcagcttctcttcctcctgctactctggcctccagtttcagataccaccggagagattgtgttgacacagtctccagccaccctgtctttgctccgaggggaaagcgccacctctcctgcgacgggccagtacagaactggttcggctcgttcgtaagcgtaggtaccaacacaaactggccaggctccaggcccctgactctactggtcgtcaacttccaaacgacggggccctaaacgtcggaccaacttccccgaaggcccgtaaacggtttccgaaaggttcggactacggggttagggtaagttacgggggaaacacggtaaccttaccgaactaccgttaccgaacctacgttacaacgttacaaacggtccgtacggtaaccgaccgttacggtaaacgtacgttacggtttaacgccgtttaagttttaaaccggttacgttaacggttaccaaaccggttacgtttaacccggttaaccgggtaacgggttaccgggtaccccgggttaaccggggggtacccctttaaccgggttttcccgggaaccccgttacgggggtaaaccgttaaacgggggtcggtaaaccgggtaagttaccccggaaaaaacggtaccgggtttacggtaacggtaccggttcggtaacccgtaccgttaaccgttacgtttaccggtttaccgtttaccgtttaaccccg

SEQ ID NO: 263244 - DNA, 782 bp, Homo sapiens
  misc_feature: GYAE6OF02F8SQ4.8.33.C11.1.454.CMB.1.raw
  modified_base (184)..(184): a, c, t, g, unknown or other
  misc_feature (184)..(184): n is a, c, g, or t
tcagctcgcgtgtccacgaccggtgctcgatttagagtgagctcgttgggtttgggggaggaactgctcagttaggacccagagggaaccatggaagccccagctcagcttctcttcctcctgctactctggcctcccagtttcagataccaccggagtagattgtgttgactacagttctccncgccctacctgttctttcgtctccggaagggaaagtcgacccacccttctccgtgccgaacgggtcctaggtacagtaacgttggttcggccgtcctttacggtaacgtccgttacggtaacccaacgaaccctaaaccggtcggaccgacggtccttaccccggaccggtccccctgtactccgttagtcgggtcgtacacgtacccgaacgaccgggacctaacggtcgaccgtaccgtcccgacgtaccgtacggtttcgacggttcgggtagtacggggttacgggtaggtacgggtaacgacgtttaaccgtccgtaaccttccccgtaccgaacttccgtaacgtaccgttacgacccgtccgggtaaggtaccgtaccggtaaggtaacggttacttcgggtacgttacgtttaagtttacttacgtacttacgtactacgtacggtacggcggttaccggccggtccgggttaccttccgggttcggtcccggacggttaacgaggttccgggaataccggtaaacgtaccggttacgtcggtacggactaccgtacgtacttcgttaccgtcgtttacccgtactcccg

SEQ ID NO: 263245 - DNA, 829 bp, Homo sapiens
  misc_feature: GYAE6OF02H8RYB.8.33.C11.1.454.CMB.1.raw
  modified_base (149)..(149): a, c, t, g, unknown or other
  misc_feature (149)..(149): n is a, c, g, or t
  modified_base (799)..(799): a, c, t, g, unknown or other
  misc_feature (799)..(799): n is a, c, g, or t
tcagctcgcgtgtccacgaccggtgctcgatttagagtgagctcggttgggtttgggggagaactgctcagttaggacccagagggaaccatggaagccccagctcagcttctcttcctcctgctactctggcctacctagtttcaagntaccgaccggagagtattggtcgttgacctacagtcctccagccctacccttgttctttcgtccgtaccggaagggggtaaaacacgcccctaccccttccgttccctcggtaccgtacggggtcccaggttaccgaaggtaacgttcggttcgggccgttccctttaggtaacgtaccgttacgggtaacccaaaacctaaccgtaaacccgttcggacccaacgggtaccctaccccggaccggtacccctacgtaacgttcctacgttggtacgctaaccgtacccgaacggtaccggaaccctaacggtccggtacctaacctccccgtaggtacccttacgggtacgtaacgggttcgaacgggttgggtaacggtacggtacgggaaacttacggtcctcgtaccttacgaccactactacgtactagtaaccggtccgtaagggtccggacttaaacggtagtacgttacggtagttacttaaacggttttacttacgggtactacccgttaaagtcgtaaccggttacccggtacgggtacccgggttccctcccgggggtaccttaccgggtttcccgggaaccgttcggaaccggtagttaccggattaaccgtacgtaacgacgtgtccgtagacccgntaacccgtgttccgtcgttcctacgttccc

SEQ ID NO: 263246 - DNA, 926 bp, Homo sapiens
  misc_feature: GYAE6OF02F9RI4.8.33.C11.1.454.CMB.1.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctgactgggttttcctcgttgcttcttttaagaggtgtccagtgtacaagtgcaacgtggtggagtcgtagggggagctagtccaggccgtgggacggtcacgagacgactccgtaccgtggtacgacgtacggccttcggttacggggtttacccaccgtttacgaaggttacgtaccgttacgggctacgttacggcaaccggtcgggtaccccgaacctaaaacccgtccgaacgggtaccgtaaacgggggtatttacggggacgggttaggggcggtccttaaggggttttcgtttacaaggttaccggtagggaacggggtccgtaggtttacgggtttacaaagggtttgggttaacgtacgtcggttacggaaccggtaccggttaacgggtacggggtacccttagttaacccaccggttactaccgtaacccggaaggtaacgaaacccgtaaccttaccgggaaaaggtaaccctaaagttaacggttacgttttaaacgggtttccgggaaacccctttagggaaaacccggttcgaacccgggtttaaaccgtcccggttaaggggtaccgggttaaccgggttaaccgggggttaactttaaccgtaaacgggttttaacccgtaggggtaaccgggtaaaccgggggggtaccgggtaaaccgggtaccggggtacgggggttaaaccgttaaccccgtaacgggtttaacccgttcgggtttaacccggtaccgggttaccggttaccggggggttaccccgtaacgggggttaccccg

SEQ ID NO: 263247 - DNA, 487 bp, Homo sapiens
  misc_feature: GYAE6OF01CT94I.9.59.F04.1.454.CMB.1.raw
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgcgggcagtcaggatgttggcgaccgcttagtctggtatcagcagaaaccaggaaaaggccctagactcctaatctatggtgcgtcccggttgcacagtggcgtcccaggagattcagcggcggtggatctagggcagatttcactctcaccatcaatcacctgcaggctgaggtattttgctaacttactactgtcagcaggctaacngctcgccccactcggccagggacacgactgganaattaacgatgngctgcacntcgtcg

SEQ ID NO: 263248 - DNA, 541 bp, Homo sapiens
  misc_feature: GYAE6OF01EFEEV.9.59.F04.1.454.CMB.1.raw
  modified_base (401)..(401): a, c, t, g, unknown or other
  misc_feature (401)..(401): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaacggccctagactctaatctatggtgcgtccggttgcacagtggcgtcccgaggaagattcgagcggcggtggatcgtagggcaggtatttcgactctacaccatcaatcactgcaggctgagtntttgactaacttactactgtcagcaggctaacgacggtctccgaccccctaaccgttccggaccgacggggaccacggacgtcgggtaaggtaacttaaaccggaacgttggtacgggtctagaccacgtagtcgttacg

SEQ ID NO: 263249 - DNA, 500 bp, Homo sapiens
  misc_feature: GYAE6OF01BIYJX.9.59.F04.1.454.CMB.1.raw
  modified_base (432)..(432): a, c, t, g, unknown or other
  misc_feature (432)..(432): n is a, c, g, or t
  modified_base (495)..(495): a, c, t, g, unknown or other
  misc_feature (495)..(495): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaagccctagactcctaatctatggtgcgtcccggttgcacagtggcgtcccaggaagattcagcggcggtggatcgtagggcagtatttcactctcacatcaatcacctgcaggctggaggtattttgctaacttactactgtcagcaggctaacnggctcgcccccaccttccggccaggggacacgacgtggagattaaacgactgtcggctgcacntctcg

SEQ ID NO: 263250 - DNA, 529 bp, Homo sapiens
  misc_feature: GYAE6OF01A2SQN.9.59.F04.1.454.CMB.1.raw
  modified_base (201)..(201): a, c, t, g, unknown or other
  misc_feature (201)..(201): n is a, c, g, or t
  modified_base (523)..(523): a, c, t, g, unknown or other
  misc_feature (523)..(523): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatggttggcgaccgcttagtctggtatcagcagaaaccaggaaaagccctagactcctaatctatggtgcgtcccggttgcacagtggcgtcccaggaagattcgagcggcggtggatcgtagggcagtatttcactctcacatcaatcacctgcaggctgaggtattttgctaacttactactgtcagcaggctaacgaggcctcgaccccctaccgttccggaccgacggggaccacggacgtacggaagtaacgttaaacgacgtggtacggtcgtacgacacctntcgtcg

SEQ ID NO: 263251 - DNA, 548 bp, Homo sapiens
  misc_feature: GYAE6OF01AW48P.9.59.F04.1.454.CMB.1.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtcaccatcaattggtcgggcgagtcaggatggttggcgaccgcttagtctggtatcagcaagaaaccaggaaaacgccctagactctaatctatggtgcgtccggtncanagtgctccaggaagntcgagcggcggtgatcgtaggcagtatttcactctcactatacaatcactgcaggctagaggttatttcgactaacttactacgtgtacagtacaacggtactaacgcggtcctacccgacccccgtaaccgtccgggaccgacggggaccacggtacgtagggaagtaacgttaaacgacgtggtacggtactacggacctacctattccgttacg

SEQ ID NO: 263252 - DNA, 535 bp, Homo sapiens
  misc_feature: GYAE6OF01AQ6R0.9.59.F04.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatggttggcgaccgnttagtctggtatcagcagaaaccaggaaaagccctagactctaatctatggtgcgtccggttgcacagtggcgtcccaggaagattcaggcggcggtggatcgtagggcagtatttcacttctcaccatcaatcacctgcaggctaggaggtattttgactaacttactactgtcagcaggactaacgcggctcgaccccctacttccggccgaggggaccaccggacgtagggaacgaacgttaaaccgacgttggtacggtactacggaccacctgtcgttacg

SEQ ID NO: 263253 - DNA, 526 bp, Homo sapiens
  misc_feature: GYAE6OF01EA3DA.9.59.F04.1.454.CMB.1.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaagccctagactcctaatctatggtgcgtcccggttgcacagtggcgtcccaggaagattcagcggcggtggatcgtagggcagtatttcactctacacatacaatcacctgcaggctgagtatttgctaacttactactgtcagcaggctaacgagtcctcgacccccaacgttccggaccgtacggggaccaacggacgtgggaataacgttaaacgaactggtacgctacgaccacctgtcgttacg

SEQ ID NO: 263254 - DNA, 510 bp, Homo sapiens
  misc_feature: GYAE6OF01A1BBE.9.59.F04.1.454.CMB.1.raw
  modified_base (333)..(333): a, c, t, g, unknown or other
  misc_feature (333)..(333): n is a, c, g, or t
  modified_base (504)..(504): a, c, t, g, unknown or other
  misc_feature (504)..(504): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatggttggcgaccgcttagtctggtatcagcaagaaccaggaaaggccctagactctaatctatggtgcgtcccggttgcacagtggcgtcccaggaantcaggcggcggtggatcgtagggctagtatttcgactctacaccatcaactcacctgcgaggctgagtattttgactaacttactactgtcagcaggctaacgagtctcgacccctacgtccggcgacgggacacgacgtcggagaagtaacgaacgtgacgtctgacacntcgtcg

SEQ ID NO: 263255 - DNA, 623 bp, Homo sapiens
  misc_feature: GYAE6OF01EQJAS.9.59.F04.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganacacagtcaccatcaattggtcgggcagtcaggntgtggcgaccgtcttagtctggtatcagacaagaaaccgaggaaacgccctaagactacctaatctagtggtcgtccgtccggttgcacgacggtcggccgtacccgaaggaacgtacttacgacggtcgggtcggtaggacgtcgtagggactagttacttcacttctacacctatacaactcacctgacgtaggtctaggtaggttacttttacgaccttaacttacttacgttcgtacgacgacgtaacggtacctaacgtacggtcctacccgaccccctaccggttccggaccggaacggggaccaacggtaccggtacgggaaagtaacgttaaaccggacgttcggtacggtaccgtacgacctaccgtgttccgttacg

SEQ ID NO: 263256 - DNA, 528 bp, Homo sapiens
  misc_feature: GYAE6OF01EV0N1.9.59.F04.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganacacagtccaccaattcaattggtccggggcgagtcgaggtatggttcggcgaccgcttagtctggtatcagcagaaaccaggaaaagccctagactctaatctatggtgcgtccggtgcacagtggcgtcccaggaacgattcagcggnggtggatcgagggcagtattcgactcgtcacatcaatcacctgcaggctgaggtnttttgctaacttactactcgtcagcacgactaacgacggtctccgacccctaccgtccggtccaggggaccaacgacgtggaactaacgttaaacgatggtcggcgtnaccnctagtcttcg

SEQ ID NO: 263257 - DNA, 812 bp, Homo sapiens
  misc_feature: GYAE6OF01CBBIZ.9.59.F04.1.454.CMB.1.raw
  modified_base (209)..(209): a, c, t, g, unknown or other
  misc_feature (209)..(209): n is a, c, g, or t
  modified_base (395)..(395): a, c, t, g, unknown or other
  misc_feature (395)..(395): n is a, c, g, or t
tcagtgatacgtctcacgaccggtgctcgatttagtacacacacttagggattgggggcaggagtcagacccagtcaggacacagcatggacatgagggtccccgctcagctccgtggggctcctgctgctctcggttccccggtgagatgcgacatccagatcgacccagtcctccattccttccggtggctgcattcgtggtggganaccacagtccaacctatactaagttcggtcgggggacgtaggtcgaagggtagtgggtttcgggaccgtacccggtcgtttacgttcgttagggttactacgagaccgaaacggaaaaccgaagggaaaaccggccctaacgtaccttacctaatcgtacggtgggtacgtccggttcccgggttnaccgtacgtacggtcgggtccgtacccgaggtaacgtcgttacggacgggtcggggtacgggtaggtacgttaccggtacggggtactaacggttacttttcccaccgttcctaccacctaacttaccaacgttccaccgttcggaccgtacggtaccgttaggtaacggtttacgttttaccggaacctttaactttaaccgttacgttaccggttaccgagttacccggtaacggtaccttaaccggtacccggtacccgttacccccgaaccccccggtttaacccgggtaccgggtaaccccggaagggggtaacccctaacgggtaaccggtacgggtaaacccgttaaacggtaaaccggtacggttacggccggtacgacgtaacccgtacctacggttccgtttacccg

SEQ ID NO: 263258 - DNA, 562 bp, Homo sapiens
  misc_feature: GYAE6OF01DHSRC.9.59.F04.1.454.CMB.1.raw
  modified_base (225)..(225): a, c, t, g, unknown or other
  misc_feature (225)..(225): n is a, c, g, or t
  modified_base (333)..(333): a, c, t, g, unknown or other
  misc_feature (333)..(333): n is a, c, g, or t
  modified_base (477)..(477): a, c, t, g, unknown or other
  misc_feature (477)..(477): n is a, c, g, or t
  modified_base (556)..(556): a, c, t, g, unknown or other
  misc_feature (556)..(556): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctcgtggttccccggttcgagatgcgacatccagatgacccagtctccatcttccgtggctgcatctgtgggagacacagtcaccatcaattgcggngagtcaggatggttggtgaccgcttagtcgttggtactcaagtacaacgaaaaccgaggaaaacggccctaagtacctacctaatctaagtggtcgtcgtcccggttnccaacgagtcggcgtacccgaggaagtagttcgaggcggtacggtggatcgtagggctagtatttcactctcaacatacaatcacctgacgaggtactgtagtatttacgactaacttactactcgtacacgtcagactaacgngactcaccccgacgtcggccgaagggacctacggacgtgaagtaagttaaacgacgttgtacggtactacgacctactntcgtcg

SEQ ID NO: 263259 - DNA, 878 bp, Homo sapiens
  misc_feature: GYAE6OF01CBTMD.9.59.F04.1.454.CMB.1.raw
tcagtgatacgtctcacgaccggtgctcgatttagtacacacacttagggagttgggggcaggagtcagacccagtcaggacacagcatggacatgagggtccccgctcagctcctggggctcctgctgctctcggttccccggttcgagatgcgacatccagatgacccagtctccattcttccgtggctgcatcgtggtgggagacacagtcaccatacaattggtcgggcgagtcaggattggttcggccgaccgtcttagtcgtaggtatcgagacaacggaaaccgaagggaaaaccggcccttaaggaccttaccgttaaatcgttaagtcgggtacggtcccggttcccgggttagacccgtacgtacgggttacgggacccgttacccggaagggtaacgtacgttaccggaacggggtccggggtacgggtacggtacgttacgggtaacggggacttaacggttaactttttccgaaccgtttacccgtaccgtaaccctaacttaaccgaaaccttacccgtaacccgttacggaccgtaacggggttaccgttaacgggttacggtttaacgttttttacggaaaccctttaaaaccgttttacccgtttaacggttaccggtttaaccgaacggtaaccgggtaacgggtaacgtttaaaccgggtacccgggttacccttacccccggtaaccccccggtttaacccggtccccgggggtaacccggtaaccggggggtaaccctaaccgggttaaccggtaaaggggtaaacccgttaaaaccggtttaaaccggtaaaccggttacggggtaccggttaccggtaccgggtaacctaacccgttagtttcccgtttacccgg

SEQ ID NO: 263260 - DNA, 762 bp, Homo sapiens
  misc_feature: GYAE6OF01EQDB7.9.59.F04.1.454.CMB.1.raw
  modified_base (208)..(208): a, c, t, g, unknown or other
  misc_feature (208)..(208): n is a, c, g, or t
  modified_base (346)..(346): a, c, t, g, unknown or other
  misc_feature (346)..(346): n is a, c, g, or t
tcagtgatacgtctcacgaccggtgctcgatttagtacacacacttagggattgggggcaggagtcagacccagtcaggacacagcatggacatgagggtcccccgctcagctccgtggggctcctgctgctctcggttccccggttgagatgcgacatccagatgacccagtctccattccttccggtggctgcatcgtggtggganacacagtccaccatcaagttcggcgggcagtcgaggtattggttcggccgtaccgtctttagtcgtggtactcgagacaacgaaaccgaaggaaaacgccctaagacctactaatctagtgggtcgccggttccggtnccgacgtaggtcggaccgtaccgaaggaactcgttacgaggcggtggtaggacgtcggtaagggtctaacggttactttaccgacttaccgtacctaaccgtaacttaacctaaccgttccgtaacccgtggaccggtaacgggtacgttaagggttaacgtttacgttttaccggaacctttaaaccgttaccgttacgtacggtacgaacggtcgtaacggtacctaaacggtccgtacccgtaccccgtaacccccgttaccgggttccgggaacccggtaaccgggggtaaccctaaccggggtacggttaaacgggtaaaccggttaaaaccggtttaaaaccgggaccggtttacgggacccgggtaccttaaccggaaccccgttaaccgttacgttcccggtttaccg

SEQ ID NO: 263261 - DNA, 855 bp, Homo sapiens
  misc_feature: GYAE6OF01BP447.9.59.F04.1.454.CMB.1.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatcccagatgacccagtcctccatccttccgtggctgcatcgtggtgggagacacagtaccaccatctaagttggtcgggcgagtcgaggtagttggttggccgaccgtactttagttcgtggtactcgaacgacgaaacggaaaccgaagggaaaaccggtccctaacggtaaccttacccgtaaattccgttaaggttcgggttcggtcccgggtttacccgggttcgaccaacggtacggtacggtccggtaacccggaaggtaacggtacgttaccggacgggtccggggtacgggttacgggtaacgttacggtaacggggctaacgggttactttaccgaacctttccgtaccctacctaactaccttaaactcccgtaaccgttcggaccggtagggtaccgttagggtaacgggtttacttttacggtaaaccctttaaccgtttaaccgttaacgtttcggtaaccgacgtccgggtaaccgggtaccggtaaccggggtaccccgtaacccggttacccccccgtaacgggtttacccgggaacccggggtaaccggggtaaccgtaccccgggaacgggttaacgggaaaccggtttaaaggttaaaacccgggttacggttaccggggttaccggtaaccggttaccgtacccgtaacccgtacgttttcccgtagttttaacccccgg

SEQ ID NO: 263262 - DNA, 924 bp, Homo sapiens
  misc_feature: GYAE6OF01A06JP.9.59.F04.1.454.CMB.1.raw
  modified_base (208)..(208): a, c, t, g, unknown or other
  misc_feature (208)..(208): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctcgtcggttccccggttgagatgcgacatccagatcgaccctagtcctccatccttccgtggctgcatcgtggtggganacacgtagtccacctatactaagttggtccgggcgagtcgaaggtagttcggttacggccgtaccgtcgtttaacggtccggttaggttactacgaaggaccaaacgggaaaaccgaagggaaaaccggtcccctaaggtaccttaccgtaaagttccgttaaggtcgggtaccggtcccggttaccggttcgacgtaccggtggtccggtacccgtacccgaagggtaactcgttacggacgggtccgggtcggtaggtacgtaccggtagggtaccgtaaagtttaccgttttcccgaaaccgttcccttaaccgaacccttaacgttaaccctaaacgttacccccgtaacccggttagggtaaacccgtaggggtacccgtttaacgggttaaacgggttttaccgttttaccggaaacccttttaaaccgttttaaccccgtacggtttaaccggttaccgaaacgggttaccgtaaacggggttaacccgttaaaccggtacccgggtccccctttaaacccccgggtaaccccccccgtttaacgggtaccccggggtaacccgggtaaacggggtaaccccgtacccgggttaaacgggtaaacggggttaaaccgtttaaaaaccgggttaaacccggttagggttaccggtccgggttaaccctaacggaacccccgttaacgtttaccggtttccggtttaaccg

SEQ ID NO: 263263 - DNA, 714 bp, Homo sapiens
  misc_feature: GYAE6OF01BRWPP.9.59.F04.1.454.CMB.1.raw
  modified_base (205)..(205): a, c, t, g, unknown or other
  misc_feature (205)..(205): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctcggttccccggttcgagatgcgacatccagatcgacccagtctccatcttccgtggctgctatctggtggganacacagtcaccatacaattggtcgggcgagtcgaggtatggttcggcgaccgcttagtctggtatcagacaagaaaccgaaggaaacgccctagacctcctaatctagtcggtgtcgtccgtgcacgtagtcggccgtaccgaaggtacgtacgttacgacggcggtcgggtaggtactcggtagggctaggttacttcgaccttctaccaccgtaatacctaaacgtcctaacccggtgaccgtacggtacgttagggtacgtttaacgttttacgaaccctttaacgttaaccgttacgttacgtaccgtacggtaccgtaaccggttaacctaacggtaccggtcccgtacccccgtacccccgttaaccggtacccgggaccggtaaccgggacccgtaaacggttaccggtaacggggtaaagttaaacccggttaaacggtaccggttacggaccgggttacccgttaacggacccctaacggttaccgtttcggtttacccc

SEQ ID NO: 263264 - DNA, 838 bp, Homo sapiens
  misc_feature: GYAE6OF01EY1EY.9.59.F04.1.454.CMB.1.raw
  modified_base (210)..(210): a, c, t, g, unknown or other
  misc_feature (210)..(210): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctcggttccccggttgagatgcgacatccagactcgaccctagtctcctatcgtttccgtggctgctattctggtggganacacacgtacaccaatcctaagttcggtaccggggacgaagtcgaggtagttggttcgggaccgtaaccgtactttaggttcgtaggttaactcaacggacaaaggaaaacccgaagggaaaaaccggccccttaaaggaaccttacccttaaatccgttaggtcgggtacggtcccggttaccggttcgaccttttaggacggtaccgggtccggttaaccgaaggtaaacgttacgttcggaacgggtcgggtaccgggttaggaacgtttaccggaaggggtaccgtaaacgtttacgtttaccaacccgtacttaacccgtaacctaacgttacctaaactcccgtaaccgtggaccgtaacgggtcggtttaacggtaaggtttacgttttaccggtaaacttaaaccgtttaaccgttacgtaaccggttacgaaacggtccgtaaacggtaaccgttaaacccgaccggtacccgttaccccgtaacccccggtaaccggttcccgggaacccggggtaccgggtaaccaaaccgggtacggtaacggtaaaggttaaacgtaaacccggtaagtaccgggtacgtaaccggtgtaaacccctacggtctttcggttaccg

SEQ ID NO: 263265 - DNA, 801 bp, Homo sapiens
  misc_feature: GYAE6OF01B54PT.9.59.F04.1.454.CMB.1.raw
  modified_base (653)..(653): a, c, t, g, unknown or other
  misc_feature (653)..(653): n is a, c, g, or t
  modified_base (793)..(793): a, c, t, g, unknown or other
  misc_feature (793)..(793): n is a, c, g, or t
tcagtgatacgtctcacgaccggtgctcgatttagtacacacacttagggattgggggcaggagtcagacccagtcaggacacagcatggacatgagggtccccgctcagctccgtgggctcctgctgctctcggttcccgtcgagatgcgacatccagatcgacccagtcctccatcctcggtggctgctatcgtggtagggacacacgacgtcaacctattacgtaacgttcggacggggactagtcgtaaggtattcgggttacggaccgtaaccggttcgtttaacgggtccttaggtacgttacgacggaacgaaaccggaaaaaccgtaacgggaaaaaccgtccctaaaggtacccttaacccgttaaaggttaccgtacggttacggggtaccggtacccggttcccgggtttagacccgttaacgtacgggttccggtacccggtaacccggaaaggttaaacgtaacgttaccgggaaacggggtcggttacggggtaacgtaacgttaccggtaacgggtacctaaggtacttttcgacccgtttacgaccaaaccgtatacctaaacgtcctaacggtcgacgaacgttcgtacggtaacggttagttttaccgacttaaaccttacgagtttaccgacgnggtaaccctaagtacccttaaacggccgtaaccttcccggaacccccgtaagttcccgggaccggttaagggacctacggtacggtaacgggtaataaacggtaaacctcggtaggtacgtcctacggacctaccggttntcgttaac

SEQ ID NO: 263266 - DNA, 492 bp, Homo sapiens
  misc_feature: GYAE6OF02IHJOF.9.59.F04.1.454.CMB.1.raw
  modified_base (428)..(428): a, c, t, g, unknown or other
  misc_feature (428)..(428): n is a, c, g, or t
  modified_base (487)..(487): a, c, t, g, unknown or other
  misc_feature (487)..(487): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctaggggcagatttcactctcaccatcaatcacctgcaggctgaggatttgacaacttactatgtcagcaggctaanggctgccccaacttccggccagggacacgactggacgataaacgactgtcgctgcaccntctcg

SEQ ID NO: 263267 - DNA, 503 bp, Homo sapiens
  misc_feature: GYAE6OF02JATSA.9.59.F04.1.454.CMB.1.raw
  modified_base (201)..(201): a, c, t, g, unknown or other
  misc_feature (201)..(201): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcagtcaggatggttggcgaccgcttagtctggtatcagcagaaaccaggaaaagccctagactcctaatctatggtgcgtcccggttgcacagtggcgtccaggagattcagcggcggtggatcgtagggcagatttcactctcaccatcaatcacctgcaggctgagtatttgctaaacttctactgtcagcaggctaacaggctcgccccaacgttccggccgacggggacacggacgtcggaagtattaaacgactgtcggctgcacctatctcg

SEQ ID NO: 263268 - DNA, 519 bp, Homo sapiens
  misc_feature: GYAE6OF02FYY5Z.9.59.F04.1.454.CMB.1.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatcgtagggcagatttcactctcaccatcaatcacctgcaggctgaggtattttgctaacttactactgtcagcaggctaacaggctcgcccccaacgttccggaccgacgggacacgacgtggaacgtaattaaacgacgtaggtacggctacgaccacctatcttacg

SEQ ID NO: 263269 - DNA, 566 bp, Homo sapiens
  misc_feature: GYAE6OF02ITO3K.9.59.F04.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacanagtcaccatcaattgcggngagtcaaggntgtggcgaccgcttagtctggtatcagcaagaaaccaggaaaacggccctaagacctcctaaatctatggtcgcgtcccggttncagagtggcgtccaggaanatcgagcggcggtgatcgtaggcagtattcacttctcaccatacaatccacctgcgaggctaggagttatttcgactaacttacgtactcgtcagcgaggactaacgcggtacctccgtacccccgtaacgttccgggacccgtaacggggaccaaccggtacgtacgggaaacgtaacgtttaaaaccggacgttaggtacggtctacgaccgaacttacgtcttacg

SEQ ID NO: 263270 - DNA, 579 bp, Homo sapiens
  misc_feature: GYAE6OF02JELW5.9.59.F04.1.454.CMB.1.raw
  modified_base (200)..(200): a, c, t, g, unknown or other
  misc_feature (200)..(200): n is a, c, g, or t
  modified_base (274)..(274): a, c, t, g, unknown or other
  misc_feature (274)..(274): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
tcagtgatacgtctcacgaccggtgctcgatttagtacacacacttaggattgggggcgaggagtcagacccagtcaggacacagcatggacatgagggtcccgctcagctcctggggctcctgctgctctggttccccggttcgagatgcgacatccagatgacccagtctccatcttccgtggctgcatctgtggganacacagtcaccatcaattgtcgggcagtcaggatggttggcgaccgcttagtcttggtattcagcaagaaaccnggaaaaggccctagacttcctaatctatggtcgcggttcccggttgccagaggttcgggcctccccgaagggaagtacttcagggtccggacgggttggaacttcgtaagggcaagtatttccgactctaccgacctactacgaattcaacctgcgacgctgagtntttgactaacttctactncagcagtctaacgngtcaccnccccaaccttcgggaccctaggggacctacggacgttcgggaactaacgttaaaccgaacgttggtacggccgttacggacctaacccagttccgttacg

SEQ ID NO: 263271 - DNA, 522 bp, Homo sapiens
  misc_feature: GYAE6OF02IU64W.9.59.F04.1.454.CMB.1.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaggcctagactcctaatctatggtgcgtccgttgcacagtggcgtccaggagattcagcggcggtggatcgtagggcagatttcactctcaccatcaatcacctgcaggctgaggtattttgactaacttactactgtcagcgagctaacacggctcgccccaaccgttccggccgacggggacacggacgtaggaacgtaagttaaacgaacgtaggtacggctacgaccaacctagtcgttacg

SEQ ID NO: 263272 - DNA, 560 bp, Homo sapiens
  misc_feature: GYAE6OF02GQIQI.9.59.F04.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatggttggcgaccgcttagtctggtatcagcaagaaccaggaaacgcctagactactatctatggtgcgtccggtgcacagtgcgtccgaggacgattcgagcggcggtggatcgtagggcagtacttcactctcaccatacaatcactgcagctggagtntttcgactaacttactactcgtacgtacgcgaggtaccttaaacgacgggtccttacccggaccccctaaccgttcccgggaccgtaaggggaccaccggacggtgggaacgttaacgtaaaccgtaacgtggtacggtacctcgaccctacgtacgtcttacgg

SEQ ID NO: 263273 - DNA, 719 bp, Homo sapiens
  misc_feature: GYAE6OF02HYW2N.9.59.F04.1.454.CMB.1.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgccatctgtgggganacacagtcaaccatcgtaaatttggtcgggcgaggtccaagggattggttcggccgtaacccgcttaaggtctaggttaatccaggacaaacggaaaaccgaagggaaaaacggtccctaaggaactccctaaaatcgtaatggtgccgtcccggggttanaccagtagcggaccgtaccaaggaactcgtacgaggtcgggacggtaggacgtacggtaggactaagttctttaccgacctttctaccaacctactacgtaaactaccaaccgtgacgtacggtacgtaggtacgttagtttacgtaacgttaaactttaaccgtaacttcgtaacgtacgtaaccgtaacggtaccgtaaacgaacggtacccgtaacccgtaccccccgttaaacgttacccggacccggaacggggtacccgaaccggtacggtaacgggaaacgtaaccggttaaaacggtaacccgttgggtacggtaccgttaccgaccgtaacccgtacttcgttacg

SEQ ID NO: 263274 - DNA, 726 bp, Homo sapiens
  misc_feature: GYAE6OF02H0OCP.9.59.F04.1.454.CMB.1.raw
  modified_base (202)..(202): a, c, t, g, unknown or other
  misc_feature (202)..(202): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (643)..(643): a, c, t, g, unknown or other
  misc_feature (643)..(643): n is a, c, g, or t
tcagtgatacgtctcacgaccggtgctcgatttagtacacacacttaggattggggcaggagtcagacccagtcaggacacagcatggacatgaggtccccgctcagctcctggggctcctgctgctctcggttccccggttcgagtatcgcgacatccagatcgacccagtcctccagtcctcgtgctgcatctgaggganatcagtcacctaatccaagttggccggagagtacgaggattggttcggcgtaccgcgttaagtcgtggtatcgagacgaacgaaaccgaaagggaaaacgttacccgtaacgaaccttaccttaaaactcgtaacgtggtacgtccgtcccgggtttgcctaaccgtagcggtacggtaccccgaaggaaacgtcttacggacggcggtcggttggaacgtaccggttagggacaaggtactttacgacttcctaccactaacttaccaaaatccccgtaaacttacgcgttaacgggcttaggaacgttatttacggaacttaaccctaaagttccttanaacccngggtaaccgtaacgttacaaacggtccgtacgtacccgtacccccccgtaaacgttcccgggacccgaaggggaaccccgtcggttaaaccggnggtaaaacgttaaacggttaaaacccggtaaacctttggggaagttacccaaggttcccccaaacgttcccgtaggtttaacc

SEQ ID NO: 263275 - DNA, 602 bp, Homo sapiens
  misc_feature: GYAE6OF02I7UWF.9.59.F04.1.454.CMB.1.raw
  modified_base (157)..(157): a, c, t, g, unknown or other
  misc_feature (157)..(157): n is a, c, g, or t
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
tcagtgatacgtctcacgaccggtgctcgatttagtacacacacttagggattgggggcgaggagtcagacccagtcaggacacagcatggacatgagggtccccgcgtcagctcctggggctcctgctgctctggttccccggttcgagatgcganatccagatgacccagtctccatcttccgtggctgctatctgtgggagacacagtcaccatcaaattgtcggcgagtcaggatggtcgcgacgcttagctggtatcagcagaaacnggaaaagcctagactactaatctatgtacgcgtccggttgcngagtgccgtcagagatcgagcgngggtgagcgtagggctagattctactctcaccatcctaaatccaaccttcgactacgggcttacggaaggttgtttttacggaccttaaactttccggtaacctttgacccgttacgacgtaccggtactaaccgtaagggccttaccgtaccccctaaaccggtccggtacccggacggggtacctaacggaacgttccgggaaagtagtttaaaaacccgaaccgttgtacggtcggtacgtcccaaccgaacgtttctccgg

SEQ ID NO: 263276 - DNA, 680 bp, Homo sapiens
  misc_feature: GYAE6OF02FNZ8Y.9.59.F04.1.454.CMB.1.raw
  modified_base (220)..(220): a, c, t, g, unknown or other
  misc_feature (220)..(220): n is a, c, g, or t
tcagtgatacgtctcacgaccggtgctcgatttagtacacacacttagggagttggggggcaggagtcagacccagtcaggacacagcatggacatgagggtccccgctcacgctcctggggctcctgctgctctcggttccccggtcgagatgcgacatccgagactcgacccctagttcctcctacttccgttccggtggctgctactctggtggganacacagtccaccattactaagttcggtcgggcgagtcgaggtattggtcggaccgaccgtctttagccgttaggtaactccagaccaaagaaaccgtaggaaacgccctaagacctacctaatcgtagtcggtcgtccggtcccgtgaccacgtacggtcggcgtaccgaggatacgtcgaggtcggtggtgtactacgtacgggactacgttactttccgaccttcgtaccaccgtataccaatcccgtacctaggaccgtaggtctacggtagtttactttcgaacctttaacgtttactaccgttacgtacgtacgtacgaaccgtacgtaaccgcggttcctaccccggtaccccttaccggtaccggaccggacgggtaccacggtacgtaaggtaaccgtaaacggttaaccgcgtaggtaccggactcggaacccttacgtacgttacttacg

SEQ ID NO: 263277 - DNA, 854 bp, Homo sapiens
  misc_feature: GYAE6OF02IJIL1.9.59.F04.1.454.CMB.1.raw
  modified_base (781)..(781): a, c, t, g, unknown or other
  misc_feature (781)..(781): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatcgacccagtcctccattccgttccggtggctcgctattcgtggtggggacacactacgtccaacctactactaagtttcgggtccgggacgagtcgaaggtagttcggttcgggaccggacccgttcgtttaacgttcgttagggttaactaccgacggaccgaaacggaaaaccgtaaaggggaaaaaccggtccccgtaagtacccgtttaaccttaaattccgttaaggttcgggttccggtccccgggtttacccgggtttgacctacggttacgggtacgggtcccgttacccggaaagggtaacgttcgttacggacgggtccgggggtaccgggtttaggtaagttccggttaacgggggactaacggtttacttttacccacccgtttacctaccgtaaccctacgtaacctaaccttacccgacccgttcggccggtaacgggtccttaagggtaagggtttacttttacgacccgtttaaaaccgttttacttaccgttacgttaccgaacggtaacccgtaacgggttaacctaaaccgggtaccgggtaccctccccgtaaacccccgttaaccgggtttacccgggacgggtaccggggtaaccncggtaacggtacggtaaacgtaaacgtaaccgtactagggtcgaacgtccggtaccaacttacgtcgttaccg

SEQ ID NO: 263278 - DNA, 766 bp, Homo sapiens
  misc_feature: GYAE6OF02INM4I.9.59.F04.1.454.CMB.1.raw
  modified_base (206)..(206): a, c, t, g, unknown or other
  misc_feature (206)..(206): n is a, c, g, or t
tcagtgatacgtctcacgaccggtgctcgatttagtacacacacttagggagttgggggcaggagtcagacccagtcaggacacagcatggacatgagggtccccgctcagctcctgggctcctgctgctctggttccccggttgagatgcgacatccagatcgacccagttcctccattccttccggtgctgcatcgtgtggganacacgagtccaccatacgtaagttcggcgggacgtagtcgaggtacttggttcgaccggtaccgtcgttagtcgtaggtatcgaacgacaacgtaaacgaaggaaaacgcccgtaagtacctacctaagtcagtcggtacgtccgttacccggttgaccgtacgaggtcggacccgtaccgaagggtaacgtacgttcgaacgggccggggtacggtaggtacttaccgggttaggctaagttacgtttacctaccctacgacctaaccgacttaaccaacttacccaccgttggaccgtaaggtcgttaacgggtaaggtttaccgttttacgaaacctttaaacccgttttaccgttaaccgtttcggtaaccgaccggtacgaaccgggttacctaaaccggccgggtaacccttcccccgaaacccccgttaccggttacccggaaccgggtaacgggacccgttacggaaccggttaacgggaaaccgttaaacgttaaaaccggcgtttaagggtcgtaccgtccggaaccaacccgtttactggtttaacccg

SEQ ID NO: 263279 - DNA, 608 bp, Homo sapiens
  misc_feature: GYAE6OF02G79S0.9.59.F04.1.454.CMB.1.raw
  modified_base (204)..(204): a, c, t, g, unknown or other
  misc_feature (204)..(204): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttcccccggttcgagatgcgacatccagatcgacccagtctccatcttccgtggctgcatctggtggganacacagtccaccatctaagttcggtcgggcgagtcagggatggttggccgaccgcttagtctggtatcagcaagaaacgaggaaaacggcctaagacctactaatctagtggtcgcgtccgtgcacngtgccgccgaggatntcgngcggnggtgatcgtaggcagtattcactctacacctatacaactccacgtgcgagctaggtgttattcgacttaacttattacgtatcgacgcgtacggtacctaacgaccgtcctacccggtacccccgtacggtacccgggtaccggacggggtacctaaccgggtacggtaacggtaacgttaaaccggttaaaacggtaccgttagggtacggtaccggtacaccccggtaaccttacggttacccgttaccgg

SEQ ID NO: 263280 - DNA, 533 bp, Homo sapiens
  misc_feature: GYAE6OF02HOCTV.9.59.F04.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (385)..(385): a, c, t, g, unknown or other
  misc_feature (385)..(385): n is a, c, g, or t
  modified_base (529)..(529): a, c, t, g, unknown or other
  misc_feature (529)..(529): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctcgtggttccccggttcgagatgcgacatccagatgacccagtcctccatcttccgtggctgcatctggtggganacacagtccaccatctaagttggtcgggcgagtcgaggtattggttggccgaccgtnttagtctggtancagacaagaaccaggaaacgcctagactctaatctagtgtgccgtcgtncangtgcnccagacntcgagcgnggngntcgagggcagtacttcactctacactactctaacnctactgacgagtcaggtagtagtttcgaacactttacactcgtacgagacgacgtactaacgcgtacctaccgaccccctacgtaccgacgacggacacggtacgtagacgtaactaacgtacgtgtgcctagacctacgtctntacg

SEQ ID NO: 263281 - DNA, 841 bp, Homo sapiens
  misc_feature: GYAE6OF02H8XYM.9.59.F04.1.454.CMB.1.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatcgacccagtctcctatcgttccgtggctgctatcgtggtagggacgacacgacgtcaacctatactaagttggtcgggacgtagtcgaagggtattggttcggaccgtacccggtcgtttagtcgtaggtactcgagacaagaaaccgaagggaaacgcctacgtacctacctaatcgtagtcggtcgtccggttcccggttgacgacgtaggtcggtccggtaccgaagggtaacgtacgttacgacggggtcggggtacgggttacgggtactaccgggttaggggtacctaagggtttaccttttccgaccttttacccgtaaccgtaaccctaacttaacccgtaaaccgttacccgtaaacccgttggacccggttaacgggtaccgttagggttaaacggtttacggttttaaccggtaccctttaaacgtttaaccgtttacgttacggtaccgtaacggtaccgtaacggttaacccgttaaaccgtaccgggttaccccgttacccggtaacccccccgtaaaccggttaccccgggtaacccgggtaaccggggtaacccgtaacccgggtaccggtaacggggttaaacgttaaacggttaaaacccggttaacgtaccgggtacggtaccggttacggtaccctaaccgttacgtacccgtttacg

SEQ ID NO: 263282 - DNA, 742 bp, Homo sapiens
  misc_feature: GYAE6OF02GX3SX.9.59.F04.1.454.CMB.1.raw
  modified_base (105)..(105): a, c, t, g, unknown or other
  misc_feature (105)..(105): n is a, c, g, or t
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (412)..(412): a, c, t, g, unknown or other
  misc_feature (412)..(412): n is a, c, g, or t
tcagtgatacgtctcacgaccggtgctcgatttagtacacacacttagggattgggggcaggagtcagacccagtcaggacacagcatggacatgagggtccccntcagctccgtggggctcctgctgctctcggttccccggttgagactgacgacatccagatcgaacccagtcctcatccgttccgngctgcnttcgtgnggacacgacgacgtccacctagtactaagttcgggtaccgggcgagtacgaaggtagttcggtacggccgtaccggtcgttaggtcttggtactcgaagaccaaaggaaaccgaaggaaacgccctagtacctacttaatcgtaggtcggtacgtccgttccggtncacgtaggtcggaccgtcgaaggtacgtactcggaggtccggnggttaacggtattaccgggtaggtcaacgggtttaacgttccctaacctttccgaacccgtactaaccgtacctaacgttccgtaacccgtgacgtacgtccgttaggtacgtttacgttactaccgttaacgtaccgttctacggtagtaacgtcgtaaccggaccgtaacggccggtacccgttacccccgtaccccgacgggttacccgggaacgtaccgggtacgaaccggttaaccgtaacgggtaaaccgtttaaaccgggaaccgttaacccggtaggttaacggcccgtaggtacctaacccggtttcggtaccgttaaccg

SEQ ID NO: 263283 - DNA, 653 bp, Homo sapiens
  misc_feature: GYAE6OF02HKM6X.9.59.F04.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatggttggcgaccgnttagtctggtatcagcaagaaaccgaaggaaacgccctaagactcctaatctagtggtcgcgtcccggttncacgtagtcggcgtacccgaggaatattcgaggcgggcggtggacttcggtaggggactagtactttaccacctttactccaacctaatacctaaacgtccaccgttagcgtaagggtcctagggtaaggtttacgttttacggaaccttaaactttacgtaacgttggtacctaaggcgtaacggactaaaccgcggtaccgttacccgacccccgtaaaccgttccgggaaccgtaacggggacctacgggtaaccggtagggaaaccgtaaacgttaaaccggaaccgttggacgggtacctaccggtacctaaccgtattaccgttacg

SEQ ID NO: 263284 - DNA, 800 bp, Homo sapiens
  misc_feature: GYAE6OF02G5R9L.9.59.F04.1.454.CMB.1.raw
  modified_base (454)..(454): a, c, t, g, unknown or other
  misc_feature (454)..(454): n is a, c, g, or t
tcagtgatacgtctcacgaccggtgctcgatttagtacacacacttagggattgggggcaggagtcagacccagtcaggacacagcatggacatggagggtccccgctcgagctccgtggggctccgtgctgctcgtcggttcccgtgagtatgcgactagtccgaagtagtaccgacccgagttcctacctacgttccgttccggtgggtcttcgctacgttcggttagggtacggtaacgacctacgtacgtaccgaacctagtaaccttaaagttcggggtccgggacgtacggtacgtagggtacgttcgggttcgggacccgtaccgttaccgtttaagtcgtaggttactacgaacgtacgaaacggtaaaaccgtaagggaaaaccggtccctaacggtaaccttacctaaacgttcgttaacgtcggtaccggtccggttaccgtnaccgtagtaggtcgtacccgtcgaagtaacgtcgtacgacggtccgggtcgtaagcgtacggtaggtactagttacgtacctacgtacctacctaaccgtctaacgaccgtcgtacgtacggtacgtacggtactggttacgttacgttacgtaaccgttaacgttaccgtacgttacgtagtacgacgtaacgtacgaacgtacccgtccgtaacccgtaccccgttacggtaccggaccgtaccggaccgtaccggtaacggtaacggttaaccgtaaaccggttaacgtaccggttacggtaccgtaccggtacctacccggtaactttccgtacgttacccg

SEQ ID NO: 263285 - DNA, 635 bp, Homo sapiens
  misc_feature: GYAE6OF01A7K1X.43.59.F04.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagtgtgagtagtcacgaccggtgctcgatttagtacacacacttagggagttggggggggtctcaggaggcagcgctctcgggacgtctccaccatggcctggctctgctattcctcaccctcctcactcagggcacagggtcctgggcccagtctgccctgactcagcctgcctccgtgtctgggtcctccgtggacagtcgatcaccatcctcctgcactggaatgcagtgacgttggaacttngaccatgtctctgtaccaacaataccaggacaaacgccccaaactctagatttangatcgtcacttactcggtccctcgtagggtttcttagtcgtcttctctggtctactaagtctggaccaacgaccggtccctccctacgacctacttcctcgttcgggaccttccgaggtctgggacggacgagggcttaggtatttacttactgacctacttactacttaaccaacgaaccgactacgttcgtacgttaacgttcgggccgggaccggtacccgaagtccgtacggtaccccggttcgtacgggtaccacggaccccgaagggtccctacccgggtcccccgttacgggtaccctacccgttccgttcccggttaccccccc

SEQ ID NO: 263286 - DNA, 515 bp, Homo sapiens
  misc_feature: GYAE6OF01ET20J.43.59.F04.1.454.CMB.1.raw
tcagtgtgagtagtcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggcctcaggggtttcttatcgcttctctggctccaagtctggcaacacggcctccctgaccatctctgggctccagctgaggacgaggctgattattactgcaactcacttacaacgaccgacacttgcgtattcggcggcggaccaagctgaccgtctaggtcagcccaaggctcgcccctcggtcactctgtccccg

SEQ ID NO: 263287 - DNA, 525 bp, Homo sapiens
  misc_feature: GYAE6OF01A6TB4.43.59.F04.1.454.CMB.1.raw
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccagcaaacgcccccaaactcttgatttatgatgtcacttatcggtccctcgtaggggtttcttatcgtcttctctgctcagtctgcacncgcctccngaccatctctggctcgagctgagacgagccgtagtattactcgtcacactactactaacgaccgacctactcgtcgacgttcggtcggacggacgacgctcgtcgtacccg

SEQ ID NO: 263288 - DNA, 515 bp, Homo sapiens
  misc_feature: GYAE6OF01EIANX.43.59.F04.1.454.CMB.1.raw
  modified_base (457)..(457): a, c, t, g, unknown or other
  misc_feature (457)..(457): n is a, c, g, or t
  modified_base (479)..(479): a, c, t, g, unknown or other
  misc_feature (479)..(479): n is a, c, g, or t
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcgaggggtttctatcgcttctctgctccaagtctggcacacggcctcctgaccatctctgggctccagctgaggacgaggctgattattacngacactcacttacaacgaccanacttgcgtattcggcggacggaccaagctgtacccg

SEQ ID NO: 263289 - DNA, 544 bp, Homo sapiens
  misc_feature: GYAE6OF01CON00.43.59.F04.1.454.CMB.1.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (531)..(531): a, c, t, g, unknown or other
  misc_feature (531)..(531): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtgcagtgacgttggaacttntgaccatgtctcctggtaccaacaatacccaggcaaacgcccccaaactcttgatttangatgtctacttatcggccctcgtagggtttctatcgcttctctggctccaagtctggccaacgaccggcctcccgtgaccctatcctcgtgggcctccgagggtctggaggacgaggctagtatttacttactgctaactcacttaacaacgaccactacttgacgtattcgggcgcgggaaccagcctcgaccgtcgtaggtcacgcccaggctcgcccctcgcncctctcgttcccc

SEQ ID NO: 263290 - DNA, 675 bp, Homo sapiens
  misc_feature: GYAE6OF01CCT8I.43.59.F04.1.454.CMB.1.raw
  modified_base (252)..(252): a, c, t, g, unknown or other
  misc_feature (252)..(252): n is a, c, g, or t
tcagtgtgagtagtcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgctacgtaggaagtagcagtgacgttggaactttncgactatgtcctccgtggtaaccaacaactacccgaggaccaaaccgcccccaaaactcttagtatttatgtattgtctactttatccggtccctcgtagggttttcttagtcgtcttctcgtcgactccaagtcgtgaccaacgaccgcctcctagacctatctcgtcggcctcgaggtctaggaggacgagctgtatttatactgactacgtacctaacgttaacaaccgaccgtaacctacgtttcgaccgtttacggttccgggaccgggtaccggaaacccgtaggtccgttaccggtaacccggttacccggttaacgggttacccgaacccggtacccccggtaagggcccttcccccgggtaccccccgttcgggttacccctaacccgtttcccgttacccgtttacccccccc

SEQ ID NO: 263291 - DNA, 667 bp, Homo sapiens
  misc_feature: GYAE6OF01AMYN3.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatcgtctccgtggtaaccaacaactacccaggaccaaacgcccccaaactcttagtatttatgatgtactacttactccggtcctcgtacgggttttcttacgtccgtctttctcgttcggtcctaccgtaacgttcgtcggacctaaacccgtacccgggtccccttcccgtacgaaccctacttccgttccggtcgggtcccttacccgaggtccgttaggacgggtaccggtaggccttagtactttacgttacgtacgtacctaacgtcctaaaccgttaaccaacccggtacccgtactaccgtttcgaccggttacggttccgggaccgggtaccgggaaccgtacggtccgttacggtaaccccgg

SEQ ID NO: 263292 - DNA, 724 bp, Homo sapiens
  misc_feature: GYAE6OF01C20ER.43.59.F04.1.454.CMB.1.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
tcagtgtgagtagtcacgaccggtgctcgatttagtacacacacttagggattggggcacgacggtgctcgatttagtacacgacacttagggattgggggggtctcaggagcagcgctctcggacctctccaccatggcctgggctctgcctattcctcaccctctcactcaggcacagggtcctgggcccagtctgccctgactcagcctgccctcgtgtctgggtctctggacngtcgatcacntcnctgcactggagtagacagtgacgttagaactactgactatgtctctgtaccaactaactaccgacgactaaacgaccccgtaaactcttagtattatgtatcgtactacttactcgtacctacgtacgggtttctttacgtcgtactttctcgttcggtccgttaccgaaacgttccgtacggtaccgaaaccgtaaccgggtacccttccccgttacggtaacccttaacgtttccgttaccgttcgggtaccctttacccgaacgggttaccgtacggaaccgggtaaccggtaacgggtcgttacggttaacgtttaaccgtttaacggtacggtaacctaaaccgttacccgtaaaccgtttaaacccgaaaccggtacccgtaactaccggtttacgaccggttaacgttacccgggtacccgggtacgggtaccccgtaaacggtcccgttaccgggttaacccccgg

SEQ ID NO: 263293 - DNA, 516 bp, Homo sapiens
  misc_feature: GYAE6OF01B5U6V.43.59.F04.1.454.CMB.1.raw
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (480)..(480): a, c, t, g, unknown or other
  misc_feature (480)..(480): n is a, c, g, or t
  modified_base (508)..(508): a, c, t, g, unknown or other
  misc_feature (508)..(508): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctctggtaccaacataccaggcaaacgcccccaaatcttgatttatgatgtcacttatccgcctcgtacgggtttcttatcgtcttctctggctccatcngcacncgcctcctgaccntctcgtcggctccgaggctggacggacgaggctgatttatactgactactcactacacgacgancttcgcgtgtcggcggacggacagtcgnggtacccg

SEQ ID NO: 263294 - DNA, 671 bp, Homo sapiens
  misc_feature: GYAE6OF01AO9BJ.43.59.F04.1.454.CMB.1.raw
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactggaatagcagtgacgttggaacttngacatgtctcctggtaccaacaactaccaggcaaacgcccccaaatctagatttangatgtcacttatccggtcctcgtagggtttcttatcgtcttctctgtctcgaagtctgacaacgacgcctccgtacgacctatctcgtcgggcctccgacggcgtacggacggacgaggtctagtaactttacgttacgtagtacctaaaccttctaaccttaaccgaaccggtaacccgtaactaccgttcggtaccggttacggttaccgggccggggtaccgggaaccctaacggtccgtaccgggtacccgttacccggttaacgggtcccgaaccggtccccggtaacgggtaccccgtccccgggttacccccccggttacgggtaccctaacccggtttcccgttcccgggttacccccccc

SEQ ID NO: 263295 - DNA, 525 bp, Homo sapiens
  misc_feature: GYAE6OF01EF1RI.43.59.F04.1.454.CMB.1.raw
  modified_base (248)..(248): a, c, t, g, unknown or other
  misc_feature (248)..(248): n is a, c, g, or t
  modified_base (423)..(423): a, c, t, g, unknown or other
  misc_feature (423)..(423): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttangactatgtctcctggtaccaacaataccaggcaaacgcccccaaactcttgatttatgatgtcacttatcggccctctaggggtttcttatcgcttctctggctccaagtctggcaacacggcctccctgaccatctctggcctccgaggctggaggacgaggctgattattacngcactcacttacaacgaccgactacttgacgtagttcggcggacggaccagcctgaccgtcgtagtcacgccaaggctcgcccctcgcactctcgttccccg

SEQ ID NO: 263296 - DNA, 726 bp, Homo sapiens
  misc_feature: GYAE6OF01BRA3M.43.59.F04.1.454.CMB.1.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
tcagtgtgagtagtcacgaccggtgctcgatttagtacacacacttaaggggattggggggggtctcaggaggcacgcgcgtctcgggacgtctcccaccatggcctgggctctgctattcctcaccctctcacctcaggccacagggtcctgggcccagtctgccctgacctcagcctgcctccgtgtctgggtctcctggaccacgtcgatcaccagtcctctgcactggaatcnctagtgacgttggaacttancgaccagtgtctcctcggtaccaaccaactacccaggacaaacgcccccaaatcttagatttactagacgtgtctacttactcggccctcgacgggtttcttatcggtcttctcgtcggtctcgtaacgtctggtaccaacgtaccgtccctacccgtacgaccctatccgtacgtcgggacctacccggaggttaccgtacgggtacgggttaaccggtaggtaccgttaggtacgtttaacgttacgtcggtaactaccgttaccttaaccttaaccgaacccggtaccgtacctaccgtttccggtacggttaccgggttaccggggccggggtacccgggtaaccgacggtccgtaccggtacccggttacccgttacgggtacccaccggtccccgtaagtacccgttcccgaccccccggttacggttaccccaccgtttcccgttcccgtttaccccccccg

SEQ ID NO: 263297 - DNA, 663 bp, Homo sapiens
  misc_feature: GYAE6OF01DIBOR.43.59.F04.1.454.CMB.1.raw
  modified_base (359)..(359): a, c, t, g, unknown or other
  misc_feature (359)..(359): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaagtagcagtgacgttggaacttatcgacctattcgtctccgtggtaccaacaactacccaggacaaaccgacccccaaatcttagtatttangtatgtactacttctccggtccctcgtacgggtttctactcgtctttctcgtcgtcctaccgtagttcgtcggactaaccgtaccgtacccttcccgacgtaccctagttcccgtacgtccgggtacctaccggacggtccgtacgggaacggtaacggtaacgggtccttaggtaactttaagtttaccgtcgtaacctaaccgttaccgtaacctttaaccgaaacccgtaacccgacttacggttacgaccggttacgttccgggaccgggtaccggaaccacggtccgtcgtaaccccgg

SEQ ID NO: 263298 - DNA, 563 bp, Homo sapiens
  misc_feature: GYAE6OF01B9H9R.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaagtagcagtgacgttggaacttatgaccatgtctcctggtaccaacaactaccagcaaacgcccccaaactcttagtatttatgatgtcacttatccggcctcgtaggggtttcttatcgtcttctctgtctccaagttcgtgcaacacggcctccctgacctatcctcgtcggcctaccgaggctacggaggaccgacggtctgtaattacttacgtgacaactaccacttacaaccgacctacacgttcgacgttacgttcgggaccggtacggaccgacgtcgtcggtaaccccgg

SEQ ID NO: 263299 - DNA, 535 bp, Homo sapiens
  misc_feature: GYAE6OF01A99VO.43.59.F04.1.454.CMB.1.raw
  modified_base (419)..(419): a, c, t, g, unknown or other
  misc_feature (419)..(419): n is a, c, g, or t
  modified_base (519)..(519): a, c, t, g, unknown or other
  misc_feature (519)..(519): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaagtagcagtgacgttggaacttatgaccatgtctcctggtaccaacaataccaaggcaaagccccccaaactcttgatttatgatgtcactttatcggccctcaggggttttctatcgcttctctgctcagtctgcacacgcctccctgaccatctctggcctcaggctgaggacgaggtctggattagttacngacactcacttacaacgccgatacttgcgttactcggacggcgggacaacgctcgtaccgtccgtaggtccacgcccaaggccttccgcccctcggtccncttcgtcgttaccccc

SEQ ID NO: 263300 - DNA, 634 bp, Homo sapiens
  misc_feature: GYAE6OF01ECJDQ.43.59.F04.1.454.CMB.1.raw
  modified_base (248)..(248): a, c, t, g, unknown or other
  misc_feature (248)..(248): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttangaccatgtctcctggtaccaacaataccaggcaaacgcccccaaacttcttgtatttatgatgtctacttacgtcggccctgtaggggtttacttagtcgtcttctcgtcggtcctacccgaagttctggtaccaaccaccgggtccctcccgtacgaacctactctcgtcgggcctaccgaggctaggaacggacggacggtctagtactttattaactcgactaacgtctaaccttacaaccgtaccgaactacgttacgacgttaacgttcgggaccgggacggaccgaagtccgtacggtacccgttacgtacgggtacaccggcccgaaggtccgtcccgtcccccgtacggtacccaccgttcccgtcgttacccccccg

SEQ ID NO: 263301 - DNA, 837 bp, Homo sapiens
  misc_feature: GYAE6OF01D2BJ7.43.59.F04.1.454.CMB.1.raw
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtgacagtcgatcacctatcctcctgactacgtagggaagttacgctaggtcggtaacggtttaggaaacctttatacggaacctattcggttccttccgtacggtaacccaaacctaaaccttaacccgaaggaaccaaaccgtacccccctaaaacttccgttagtactttagtagtattcgtactacttacgtccggtccttacggtacgggttttacttacgtccgtcttcgtcgtcgtctaccgtaagttctacggaccaaccgtaccggtccctaccctacgtaacctacttccgttcggtaccgggtcctaccggacgggtacgttacgggaacgggacggtacggtcgttagttaacttttacgttacgtacgtaacctaaccttaccgtaaccgttaaaccgaaccgaacccgtaacgttaccgttacggttaccggtttacggttccggggacccgggtaccgggtaaaccctaaaggttcccgttaaccgggtaaccccggtttaccggtaaccgggtacccggtaaaccccggtacccgggtaaaccgggttccccgttccccccgggttaccccccgttaaccgggtaccccttccccggtttacccccgttcccggtttacccccccccg

SEQ ID NO: 263302 - DNA, 670 bp, Homo sapiens
  misc_feature: GYAE6OF01CHJT9.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgccctcgtgtcgtgggtctccgtggacagtcgatccaccatcctcctgcacgtggaagtagcgtagtagtacgttaggaacttatacgacctagttcgtcctccgtacggtaacccaaactaactacccgaggaccaaacccgaccccctaaacttcttagtaatttatgtactcgtactacgttacgtcccggtaccctacggttagggtttcttacgtccgtctttcgtcgtcgtcctccgtaacgttccgtacggaccgaaccgtcccggtccctacccgtacaccgtacttccgtcgtcggtcctccggaggtccgtaggacggaccgtggtacgttagtaactttactacgacgtacctaccgttacctaccgttaaccgaaccgtccgtacttacgttcggtacgttacggtccgggacggaccgaaccgtacgtccgtacgtacccgg

SEQ ID NO: 263303 - DNA, 757 bp, Homo sapiens
  misc_feature: GYAE6OF01B31RO.43.59.F04.1.454.CMB.1.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (373)..(373): a, c, t, g, unknown or other
  misc_feature (373)..(373): n is a, c, g, or t
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcgagggcacgagggtcctcgggcccagtctcgccctgactcagcctgcctccgtgtctgggtctccgtggacagtcgatcacntctctncacgtggaagtagcgtagtgacgttaggaacttatacgacctatcgtcctcctacgaaccaacgaactaccgacggacaaacccgacccctaaatctagtatttcagtactntctaacttacgccggtcccttaggttacgggtttctagtccgttacttcgtcgtcgtcctacgtaagttcgtcgaccaccgtaccggtccctccgtagaccctacgttcgtcccggtcggtacccgtaccgtagggtacccgtagggtaaccgggtaaccggtccgggttaacgtttacgtaaaccgtttttacgtacccgttacggtaaccccttaaacgttacctaaaacccgtttaacccggaaaaccccgggttacccgttaaccgttaccggtttcccggggttaaacccggttacccgggtttcccgggggtaaccccggggaaacccggtttaaccggtaacccggtaaccccgggttaccgggttaaacccccggg

SEQ ID NO: 263304 - DNA, 539 bp, Homo sapiens
  misc_feature: GYAE6OF01BMZX7.43.59.F04.1.454.CMB.1.raw
  modified_base (425)..(425): a, c, t, g, unknown or other
  misc_feature (425)..(425): n is a, c, g, or t
  modified_base (502)..(502): a, c, t, g, unknown or other
  misc_feature (502)..(502): n is a, c, g, or t
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaacgcccccaaactcttgattatgatgtcacttatccggtccctcgtacggggtttctagtcgtcttctctggctaccagtctggaccaacaccggcctccncgaccatcctctgggcctcgacggctggacggacgaggctgtatttatacgtcgacactcacttacaacgccgtacncgtcgcgtactcggcggacggacacgcgtgtacccgg

SEQ ID NO: 263305 - DNA, 683 bp, Homo sapiens
  misc_feature: GYAE6OF01DOIGZ.43.59.F04.1.454.CMB.1.raw
  modified_base (343)..(343): a, c, t, g, unknown or other
  misc_feature (343)..(343): n is a, c, g, or t
  modified_base (447)..(447): a, c, t, g, unknown or other
  misc_feature (447)..(447): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctctcactcagggcacgagggtcctgggcccagtctgccctgactcagcctgcccttcgtgtctgggtctccgtggacagtcgatccacctattccgtcctgctacgtggaatgcgaggttagtacggttaggtaacttagtacgacctatcgtcctcgtacgtaacaaacaacctaccgagaaccaaacccgtacccctaaacttcgttagttatttangtacttcgtacttaacttacgtccggtccgttaggttacggtttactctcgtcttctacgtcggtctacgtacttgacacgaccaccgtccctccgagtacctnttccgtcgtacgtcctcggaggtcgtacggtacggacgtagtgttataacgttacttcagtaccacttacgtaactaaccgtaaccgcctaagtccgtcgtacgaccggttccgggacgtaccggaacgtacgttcgacccgttaccggtacttaccggactaacccggaccgtaccggtaccctccccggttaccccgtaccggtaaccttcccgttaccgttcccccgtacccc

SEQ ID NO: 263306 - DNA, 664 bp, Homo sapiens
  misc_feature: GYAE6OF01CMCXB.43.59.F04.1.454.CMB.1.raw
  modified_base (181)..(181): a, c, t, g, unknown or other
  misc_feature (181)..(181): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (520)..(520): a, c, t, g, unknown or other
  misc_feature (520)..(520): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcaggcacngggtcctgggcccagtctgccctgactcagcctgcctccgtgtcgtgggtctccgtggacagtcgatcaccatccnctgcacgtggatagcagtcgtacggttggaaacttntacgacctagtcgtaccttccgtaggtaacccaactaactacccgaggaccaaaaccgtaccccctaaacgtcttacgtatttagtcgtattcgtactacgttacgtccgtcccttaggtacgggttttctacgtcgtactttcgtacgttcgtacctacgtaacggttctacggaccaaccggaccgtcccttccgacgtacctactccgtcggcggtccctacgnggtactcggaacgacggtagtactaggtatttacgtactcgaaccctacttacccaaccttaaccgacgtacccgtacgttaacgttcggaaccgttacggtaccgggtacggacccggtaacaccgtcggttcccggtacccg

SEQ ID NO: 263307 - DNA, 723 bp, Homo sapiens
  misc_feature: GYAE6OF01CSP18.43.59.F04.1.454.CMB.1.raw
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcgatcactatcctctgcactggaacgtagctagtgacgttggaacttagtgacctagtcgtacttccgtaggtaacccaacaacgttacccgaacggaccaaaccggaccccctaaacgttccgtttaggtaacttttaacgtacggttaaacttcggttaacctacgtttaactacccgggtacccgttacggtttaacgggggttttaccttaacgttccgttctttaccgtcgttcgggtcccttaaccgtaacgttcgttacgacctaacgacccggtccctaccgtacgaacctatccttcggtacgggtcctacccgtaggacccgtaggaacggtacggacggtacgttggaactttacgttacgtacgtacctaacttaccgaaccttaacgtaaccgaccgtacttaacgttcgggtacgttacggttaccgggcgggtaccggtaaccgacgtccggtacgttaaccccggg

SEQ ID NO: 263308 - DNA, 663 bp, Homo sapiens
  misc_feature: GYAE6OF01C903V.43.59.F04.1.454.CMB.1.raw
  modified_base (303)..(303): a, c, t, g, unknown or other
  misc_feature (303)..(303): n is a, c, g, or t
  modified_base (561)..(561): a, c, t, g, unknown or other
  misc_feature (561)..(561): n is a, c, g, or t
tcagtgtgagtagtcacgaccggtgctcgatttagtacacacacttagggattgggcacgaccggtgctcgatttagtacacacacttagggagttggggggggtctcgaggaggcagcgctctcgggacgtctccaccatggcctgggctctgctattcctcaccctcctcactcgagggcacgagggtcctcgggcccagtctcgccctgactcagcctgcctcgtgtcgtgggtcctcgtggacagtcgatcactatctctgctacgtggaagtagcgtgtcgtacgttaggtaacttangaacctagtcgtcctaccgtaggtaacccaaacaactaacccgaagaccaaaaccgacccccctaaaagttcctttaagtaatttagtacggtacttacgttactaacgtttacgtccggtcccttaggtacggggttttcttagtccgttcgttacttcgtcgtactaccagttccgtagacctaacgacccgtcctcccagactactcggtcgtcggcctcgagcgtacggacgagcggtagtatactttagtacncgtactaaccgtactaacccgtaaacaaccggtaactaccgtcgtacgttacggtacgttccgggacgggaacccggataaaccggtcgtacccggtaacgg

SEQ ID NO: 263309 - DNA, 701 bp, Homo sapiens
  misc_feature: GYAE6OF01B6E0O.43.59.F04.1.454.CMB.1.raw
  modified_base (457)..(457): a, c, t, g, unknown or other
  misc_feature (457)..(457): n is a, c, g, or t
tcagtgtgagtagtcacgaccggtgctcgatttagtacacacacttagggagttgggggggggtctcaggaggcagcgctctcgggacgtctccaccatggcctgggctctgctattcctcaccctcctcactcagggcagaggtcctgggcccagtctgccctgactcagcctgcctccgtgtctgggtctccgtagggacacggtcgaatccaccagtcctccgtgctacgtgggaaagttgaccaggtcggtagttaggaaacttatcggacctatcgtcctccgtacggtaacaaacaactaccgacggaacctaaccgacccctaaatcgttagtattagtactagtctactacttacgtccggtcctacggttaacgggttttctacgttccgtcgtttccgtcgtgtcctacgtaagtcgtcgacacgtaccggtcctaccgacgtaccncgttctccggtacgccgttaccggacggttacgagggacggtaacggacggtcgtaaggttacttacttacgtacgacgtactacgtaactaccgaaaccgtcacgtacgtacgtacgtacggttccggacgggtaccggaacgtacgtccgttacggtaccggtacgtacggtaccgaaccggtccgaaccggtccttaccccggtccccgttacggacccttcctccggtcccttacccccg

SEQ ID NO: 263310 - DNA, 871 bp, Homo sapiens
  misc_feature: GYAE6OF01DLFT0.43.59.F04.1.454.CMB.1.raw
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
tcagtgtgagtagtcacgaccggtgctcgatttagtacacacacttagggattgggcacgaccggtgctcgatttagtacacactacgttagggaggttggggggggtctcgaggaggcagcgctcgtcgggaccgtcctccaccagtcggccgtgggctctcgcttacttcctccaccctcctcactcgacggcacggtcggtccgtacggccagtcctcgccgtcgactcacgcctcgtccgtcgtgtcgtcgtctcgngacncgcgcacactctctctcgacgtagaggaatgacgtagacgtacgtagtactacgacgtacctgtccgtacgtaccgtaacgaaacctaacaaccgtaccgacgaacccaaccgtaccctaacgttcttacgttaattacgtagtacgtaacgttctaacgttccggtccccgttaacggttacggtttacggtttccttaacggtcgttaccgtttccgtaccggttccgttacccgtaacgttaccgggttacctaacggtacccggttaaaccccggttcccgttaaccccgtacccgtttaacccgtaccgtttacccggtttcgttacccgggtacccgttaccggtaaccgggtacgggttaccgggtaacggggtaaccgggtaaccgggttacgttaaccgtttaaccggttaactttaaccggtcgtttaacccgaaccgtttaccggttaaacccttaaaaccgggtaacccgtaaaaccccgggttcccgtttaccgggttaaccgtttacccggggtaaccggtttcccggggtaaaccgggcccgggttaaaccggacccgttaacccggttaccggttaacccgggttaccgg

SEQ ID NO: 263311 - DNA, 854 bp, Homo sapiens
  misc_feature: GYAE6OF01D789R.43.59.F04.1.454.CMB.1.raw
  modified_base (607)..(607): a, c, t, g, unknown or other
  misc_feature (607)..(607): n is a, c, g, or t
  modified_base (799)..(799): a, c, t, g, unknown or other
  misc_feature (799)..(799): n is a, c, g, or t
tcagtgtgagtagtcacgaccggtgctcgatttagtacacacacttagggagttgggggggggtctcaggaggcagcgctcgtcgggacgtctccaccatggccgtggctctgctattcctcaccctcctcactcgagggccaacggtacgggttcccgtgggccccgtagttccgtcggtcccctggacctcgacgtccgtcgtccgtcggtgttccgtcgggtctcgtaggacgtgtcatccactattccgtactcgtacacgtaggacggtacacggtagtacgtcggtttagtaaacttacggtacgaaccgttagttccgtaccgttaccgttaaaacggtaaaccccaaacgtaaaccgttaacccgaaccgggtaaaacctaaaacccccggtaacccccttaagtttttcgttaaccgtttaaacgtttaagttccggttaaacgttcgttttaacccgtaactttccggggtcccttaaccccgggtttagggtttaccggttttaccttacgtttcgggtaacttccgttaagtccgtaccgttacgtcgtagtaaccggtacgacccgttaccggtaccctacggtaccaccgttnttcccggtacggtccgctcccggtagtacggtaggacggtaggtcgtaggttacttacgttactagacccgttacgtactaaccgttaaccgaacgtaaccgtcccgaattccggtagtaaccggttcggacgggtaaccgcggaacgttacggaccggtaggtacccgtagtcccggtacaccggtaccgnggtccccctaaccgggtcccttacggtccaccccggtttccgcccgttaccccgg

SEQ ID NO: 263312 - DNA, 802 bp, Homo sapiens
  misc_feature: GYAE6OF01DL2IC.43.59.F04.1.454.CMB.1.raw
tcagtgtgagtagtcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaagagcgaggtgtacggttaggtaacttagtcgactagtcgtcttccgtaggtaaccaaactaactaccgaagaccaaaccgaccccctaaacttcttagtaatttagtgtactcgtactacttacgtaccgtccgttacggttacgggttttcttacgtccgttctttccgtcgttcggtaccttaccgtaacgttcgtacgaaccgtaaccgtacccggtcccctacccgtacgtaaccctacgttcccgttcggccggtcccttaccggaaccggtcgttaacgggaaccggtacggtacggtcgtttaagttaacgttttacgtttaaccgtacgtacccttaaaccgttacccgtaaacgtttaaccccgaaaccggtaaccccgttacgttaaccggttcggttaaaccggttccgggttacccggggtacccgggaccgggtaacccgtaacggtaccggtacccggtaacccggttaccgtacggtacccggtaacccggtaccggacccggtccgttaccccggtccccgttacggtccctccgttccccgttcccggttcccccc

SEQ ID NO: 263313 - DNA, 613 bp, Homo sapiens
  misc_feature: GYAE6OF01BIRIW.43.59.F04.1.454.CMB.1.raw
  modified_base (248)..(248): a, c, t, g, unknown or other
  misc_feature (248)..(248): n is a, c, g, or t
  modified_base (437)..(437): a, c, t, g, unknown or other
  misc_feature (437)..(437): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaagtagcagtgacgttagaacttngaccatcgtctccgtaggtaaccaacaactacccaggaccaaacgccccaaacttcttagatttatgattgtacacttacgccggtcccttacgtacgggtttcttagtcgtcttcgtcgtcgcctaccaagttctcggaccaaccgtacggtcctacccgtagaccctatccgtcgtcggcctaccgngtcgtagggacggacggacggctagtacgtttactacgtacgacctaacctctaacctaaccgaacgacctacctacgtgtacgtacgttcggcggccggaccgagtctcgaccgtcgacggtacacggccgacgtcctcccgtcccccgtcgtacctcgtccgtccgttcccccg

SEQ ID NO: 263314 - DNA, 860 bp, Homo sapiens
  misc_feature: GYAE6OF01EIQ0I.43.59.F04.1.454.CMB.1.raw
tcagtgtgagtagtcacgaccggtgctcgatttagtacacacacttagggattgggcacgaccggtgctcgatttagtacacacacttagggagttggggggggtctcaggaggcagcgctctcgggacgtctccaccatggcctgggctctgctattcctcaccctcctcactcaggcacgacgggtcctgggcccagtctcgccctgactcacgcctcgcctcgtgtcgtcggtcctccgtggacagtcgatccaccatcctcctgctacgtaggaagtacgacgtagttcggtacggttaggtaaacctttacgtacgtacccgtagttcgttacccgttcccgttaccggtaaaccctaaacctaaaccgtaacccgaacgggaacccctaaaacccgtacccccctaaaactttccgttacgttaacgtttagtacgtagtttaccgttaacgttaaccgttaccgtaccccggttcccgtttaccggtttacggggtttttaccttacgttccgtttccgtttaccgttcgtaccggtaccttacccgtaacggttccgtaacggacccttaaaccccggtcccggtaccccttacccgtaaccgaccctttaacgtttcccgggttccggttaccgggtaccccttaccgggtacgggttaccgtaaccggggacgggtaaaccggcggtttaccgttaagtttaaccgttttaacgtacgtacccgtaaacctacccttaccgtaaaccttaaacccggaacccgtacccgtaacgttaccgttcggtaccggttacggggtacccgggacgggtaacccggaccgttaaccgtccgtaccggtaacccggg

SEQ ID NO: 263315 - DNA, 794 bp, Homo sapiens
  misc_feature: GYAE6OF01D9LHZ.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgcttattcctccacccttcctcactcgagggccacgtacgggtccgtcgggcccagtcctcgccctgacctcacgcctcgccctcgtcgtccgtcgggtcctccgcggacacggtcgactccacctacttccgtcctcgaccgtacgtagggaagtacggtaccgtaggttacggtacggtttacgtaaacgtttcgaccgtaactgtcgttccgtaccgtaccggtaaaccaacgtaaccgtacccgaacggaacctaaaaccccgtacccctaaacgtttcgttacgtaactttagacgtacgttacgtacctaacgttactcccggtaccgtttacggtttaacgggtttccttacgttccgttcctttccgtccgttcggtaccctacgtaacggttccgaggtaaccctaacccggtccgtccctaccgtacgtacctcgttcgtccgtcggacccgtcgtaacggcgtaacgggacgtacggcgtacttaggttacttacgtactaccgtaacctaaccgtacttaacccgtaacgtaccccgtaacttaccggttacgtttacccggttacggtaaccgggtccccggggtagggtaaccccgggtaactaccgggttcggtaccccgtaaccggg

SEQ ID NO: 263316 - DNA, 519 bp, Homo sapiens
  misc_feature: GYAE6OF02G83GC.43.59.F04.1.454.CMB.1.raw
tcagtgtgagtagtcacgaccggtgctcgatttagtacacacacttagggattgggcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaatcacttacaacgaccgacacttgcgttatcggcgccgggaccaaggctgacccg

SEQ ID NO: 263317 - DNA, 508 bp, Homo sapiens
  misc_feature: GYAE6OF02HGML4.43.59.F04.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagtgtgagtagtcacgaccggtgctcgatttagtacacacacttagggagttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgtttggaacttatgaccatgtctcctggtaccaacaatacccaggcaaagcccccaaatcttagatttangatgtcacttatcggccctnagggtttctatcgcttctctggctcaagtctggcaacacggcctcctgaccatctctgggctccgaggctgaggacgaggctgattattactgcaactcacttacaacgacgacacttgcgtattcggcgcggacagctgaccgtctaggcagcccagctcgcccctgtcacgtctgtcccc

SEQ ID NO: 263318 - DNA, 519 bp, Homo sapiens
  misc_feature: GYAE6OF02H0VB3.43.59.F04.1.454.CMB.1.raw
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagtgtgagtagtcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggacaaacgcccccaaactcttgattttatgatgtcacttatcggccctgagggttttctatcgcttnctgctccaagtcngcaacncgcctccngaccatctctgggctccgaggctgaggcgaggctgattattacngtacaactnacttacaacgccganacgttgacgtagttcggcggcggacagctgaccgtctaggcagcccgagcctcgcccctcggtcacgtctccgttcccc

SEQ ID NO: 263319 - DNA, 684 bp, Homo sapiens
  misc_feature: GYAE6OF02HCM5S.43.59.F04.1.454.CMB.1.raw
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaactacccagacaaacgcccccaaactctagtattatgtatgtacacttatccggtcctcgtagggtttcttatcgtcttctcgtcggctctaacgtctaggcaaccgaccggtccctccctacgaccctactcgtacgtcgggcctcccggaggtccgtggaacgggtacggacggtacgtaggtatttaacgttaccgtagtaccctaaactcctaaaccttacccgaaaccggtacccgtaaccgtaccgtttacggaccgtttaccggttcccgggaccggggtaccggtaaaccgtacgggacccttacgggaacccggttaccgtaacgggtcctaacggaccccgtaaggtcccgttacccggccccccgttacggtaccctaccgttcccgtacccggttaccccc

SEQ ID NO: 263320 - DNA, 584 bp, Homo sapiens
  misc_feature: GYAE6OF02IMGT6.43.59.F04.1.454.CMB.1.raw
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaacgcccccaaactcttgatttatgatgtcacttatcgccctgagggtttctatcgcttctctgctcaagtctggcaacgcggcctccctagaccctatcctctcgggctccgaggctggaggacgaggctagatttattacgtgactaactctacttaacaacgaccgactacttcgacgtacgttccgggcgggacggaccaacgtctacggtaaccggttccgtaagggtccacggccccgaacgggcccttaccggcccccgttcgggtccctaacgttcccgtccggttccccccgg

SEQ ID NO: 263321 - DNA, 692 bp, Homo sapiens
  misc_feature: GYAE6OF02H54C5.43.59.F04.1.454.CMB.1.raw
tcagtgtgagtagtcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaatagcagtgacgttggaacttatgacctatgtctcctggtaccaacaactaccaggacaaacgccccaaaactcttagatttatgatgtctacttactcgtccctgtacgggtttcttagtcgtcttctctacggtctacctaagtcttggacaaacgaccggcccttacccctcgtaccgtaatccgtccttcgggtccttcccgtaacgggtctacggaacggtaccgggaacgggcgttacggtaatttacgttaacgttacgactaaccttactaactttaaccaaaccgaaccgtaacctaccgtttacgaccgttacgttaccgggccggggtaccggtaacccgaacgtccgtaccggtaacccggttccgtaacgggtacctaccggtaaccccgaacgggtccgttaccggtccccccggtccgggttaccgaccgtttcccgttccggtttaccccccg

SEQ ID NO: 263322 - DNA, 677 bp, Homo sapiens
  misc_feature: GYAE6OF02IC5BW.43.59.F04.1.454.CMB.1.raw
  modified_base (253)..(253): a, c, t, g, unknown or other
  misc_feature (253)..(253): n is a, c, g, or t
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
  modified_base (521)..(521): a, c, t, g, unknown or other
  misc_feature (521)..(521): n is a, c, g, or t
tcagtgtgagtagtcacgaccggtgctcgatttagtacacacacttagggattgggggggtcgtcaggaggcagcgctctcgggacgtctccaccatggcctgggctctgctattcctcaccctcctcactcagggcacgagggtcctggcccagtctgccctgactcagcctgcctccgtgtctggtctcctggacagtcgatcaccatctcctgcacgtaggaagtagctagtggtacgttggaaactttntcggaacctatggttcctccttaggtaccaaacaactacccgaaggaccaaaacgccccctaaacgtcttgtaatttttacngtaactgtactaacttatcccggtcctacgtagggttttcctagtcgtctttcncgttggtcctactaacgtcgttaggaccaaacgccggtcccttacccgtcgaccctatttctccgtcgggtccctaccgaggtcctagggaggaccgtaacggtctcgttaattacgttacgtcgactaacncttaacgtacgaacgaccgctacttacgcgtagttcgccgggacggaccagccgtacgtacccgtacgttacggaccctacggtaacccgaacggttccggttacccgtacccccgtacggttcccgtacttccccgttaccgtttaccccccccg

SEQ ID NO: 263323 - DNA, 695 bp, Homo sapiens
  misc_feature: GYAE6OF02J0I2A.43.59.F04.1.454.CMB.1.raw
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtgtgagtagtcacgaccggtgctcgatttagtacacacacttaggattgggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggaagtagcagtgacgttggaacttagngaccatgtctctggtaccaacaatacccaggcaaacgcccccaaatctgatttatacgatgtctacttancggccctagtacggggtttccttagtccgtctttccgtcttacgggtcctaccgtaaacgttccgtaggtaccgaaaccgtaccgggtcccctttccccgtacggacccctacttaccttccggttccggggccttaccccggtaggttcccgacgggtaacggccgggaaaccggtcgttacggtaatttagttaccgtggaaccctaacctttaaccaacgttacctaaacgacccgtaactacgtttacgcgtttaacgtcgggaccgtacgggtaccaagttccgagtcccgtacgtaacggtcccacgtacccggtaacgtcgttcccgtcccccggtacgttaccccacgtttcccgtacggtttaccccccc

SEQ ID NO: 263324 - DNA, 533 bp, Homo sapiens
  misc_feature: GYAE6OF02F05KH.43.59.F04.1.454.CMB.1.raw
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (457)..(457): a, c, t, g, unknown or other
  misc_feature (457)..(457): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaagtagcagtgacgttggaacttatgaccatgtctcctggtaccaacaataccaggcaaacgcccccaaactcttgatttatgatgtcacttancgcctctaggggtttctatcgcttctctgctcatcnggcaacncgcctcctnaccattctctcgggctccaggtccagagacgaggctgattattctcgnaaccttcacttacaacgaccgaacaccttcggacgtaagttcggccgggtcggacccaaggtcccgtggtacccgg

SEQ ID NO: 263325 - DNA, 682 bp, Homo sapiens
  misc_feature: GYAE6OF02GYQ9R.43.59.F04.1.454.CMB.1.raw
  modified_base (339)..(339): a, c, t, g, unknown or other
  misc_feature (339)..(339): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtcctgggtctcctggacagtcgatcaccatctcctgcactggaagtagcagtgtacgtttggaacttatcgaaccatcgttcctccgttaggtaaccaaactaaactaccccgaaggacctaaaaccgcccccctaaaactcttacgtattttancggtattcgtactacttactccggcccttcgttacgggtttcttagtcgtcttctcgtagctcagtctcggacaacgaccgtcctcccgtagacctactcgtcgtcggcctccgaggtctacggaggtacggagtcgtagtatttaacttcgtagtacctaacctactaaccttaaccgaaccgacctaacctacgttcgaccgttacggttcgggccgggaccgaaccggtacgcgttacccggaaccgttaccgtaacggtacctaccggaccgtaaacggtcccgtaccccggttcccccgtacggttacccgaccgtttcccgtacccgttccccccgg

SEQ ID NO: 263326 - DNA, 596 bp, Homo sapiens
  misc_feature: GYAE6OF02ISGR1.43.59.F04.1.454.CMB.1.raw
  modified_base (250)..(250): a, c, t, g, unknown or other
  misc_feature (250)..(250): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcacgtggaatgcagtgacgttggaacttagngaccatgtctcctggtaccaacaatacccaggacaaacgcccccaaacttcttagattttatgatgtctacttactccggccctcgtagggtttctatcgtcttctctgctcagtcnggcacacgcctccncgacctatctcgtcgggcctcgaggtctggaggacgcggctgtattattactgacctaactcacttaacgaacgacctactacgttgacgttagttccgggacggacggaaccagtccgtacgacccgttccgtaaggtacccacggtaccccgaagggtccctcccggtacccccgttcgggtaccctaccgttaccgttcccgttaccccccc

SEQ ID NO: 263327 - DNA, 769 bp, Homo sapiens
  misc_feature: GYAE6OF02IQLCE.43.59.F04.1.454.CMB.1.raw
  modified_base (248)..(248): a, c, t, g, unknown or other
  misc_feature (248)..(248): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaatagcagtgacgttggaacttangaccatgtctcctggtaccaacaactaccccaggaccaaacgaccccccaaacttcttagtattttatagtatcgttacctaactttacgtccggtccccttcggtacggggttttccttacttccggttcctttcgttccgtcgggtccttacccgtaaggttcctacgggtaccaaaccgtacccgggtccccttaccccgttacggaccctacgttcccgttcggttacggggtcccttacccggagggtccgtaggggaacgggaacgggacgggtacttagggtaattttacgttacctacggtacctaaaccttacctaacccgtttaaaccgaaccgtaaccgtaccttaacgtttacggtccgtttaacggttccgggccggggtaccggaacccgtaggtcccgtacggtaacccgttcccggttaacgggtccaaccgggtaccccgaacgggtccctacccggtcccccggttcggtacccgtaccgttcccggtcccggttaccccccg

SEQ ID NO: 263328 - DNA, 641 bp, Homo sapiens
  misc_feature: GYAE6OF02G6JUR.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcaggcacagggtcctgggcccaggtctggccctgactcagcctgcctccgtgtctgggtctcctggacagtcgatcaccatctcctgcactggaagtagcagtgtacgttggaacttatgacctatgtctcctggtaccaacaactacccaggacaaacgaccccaaacttctagtattactagtatcgtctaacttacgtccggtccctacgtacggggttttaccttaacgttccgtactttccgtcgttacggtcctaccgtaacgtcgtacggtccaaccgaccgtccctcccgtacgtaccctaccttcgtaccgtcgggtcctaccgtacgtcgtaggtacggacggacggtcgtacgtattaacgttctacgacctaacgtaccacgttaaccgaacgtaccaccgtacgttacgcgttaaggtccggtacgggaccggtacgacgtccgtaccgtaccgg

SEQ ID NO: 263329 - DNA, 682 bp, Homo sapiens
  misc_feature: GYAE6OF02HLVIE.43.59.F04.1.454.CMB.1.raw
  modified_base (251)..(251): a, c, t, g, unknown or other
  misc_feature (251)..(251): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaatagctagtgacgttaggaacttnacgaccatcgtctccgtacgtaccaacaactaccgaggacaacgaccccctaatcttagatttagtagtatcgtactacttacgtccgtcctaggttacgggtttcttacttcgtcttacgtccgtcggtacctacgtaacttcggtacggtaccaccgtaccggtccctaccgtgtacctacgtcgtcgtcggcctacggacgtcgtaggacggtacggtacgtacgttagtattacgttactcgaaccttaacgtctaaccttaaccgaaccgtacgtacctacgttacgtacggttaccgtacgggtcggacccgaccgtaggtccgttaccggtaccgttaccggttaacgccgtaaccgtacccggtaacggtcccgttaccccggtcccggtaccgttcctaaccgttccttaccccgttacccc

SEQ ID NO: 263330 - DNA, 655 bp, Homo sapiens
  misc_feature: GYAE6OF02HWLF6.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctctcactcaggcacgaggtcctgggcccagtctgccctgactcagcctgcctccgtgtctgggtctcgtggactagtcgatcaccatcctctgcactggaagtacgcagttgacgttggtaaaccttagtcgaccattcgtcttccgtggttaacccaaacaactacccaggaccaaacgccccaaactcttagactttaatcgattgtacactttactcggccctagtacgggtttcttagtcgtccttctcgtggtacctaccgtaagtcgtacggacgaaccgaccggtacctcccgtactacccacgttaccgcttacgggtccctacgacgtcgtaggaccggagtacggccgttagaatttaagttaccgtagaccgttaacgtacctacttaaccgaaccggtaccgtaaccgtacttacgtacgttaaccgtttcgggaccggtacccgggtaacctaacggtacccgttaggtaaccccgg

SEQ ID NO: 263331 - DNA, 628 bp, Homo sapiens
  misc_feature: GYAE6OF02FMBCA.43.59.F04.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagtgtgagtagtcacgaccggtgctcgatttagtacacacacttagggattgggggggggtctcaggaggcagcgctctcggggacgtctccaccatggcctgggctctgctattcctcaccctcctcactcagggcacagggtcctgggcccagtctgccctgactcagcctgcctccgtgtctgggtctcctggacagtcgatcaccatctccngcactgggaagtgcagtgacgttggaacttngaccatgtctcctggtaccaacaactaccagacaaagcccccaaactcttgatttangatcgtcacttntccggcctcgtaggggtttcttactctcttctctcgtctaccgagtctgacaacgacgtccctccctagacccacttctcgtggtcctacccgaggtcgtaggacggacgacggtcgtagtattttagttacgtgtacctacctacttacctaacgtaaccgaccgtacgtcttacggacgttcgttaccgggcggtaccgggaacctaggtccgtacgtacccggttcggtaacggtaccgaaccgtcccgaacggtccctccgggtcccccttagggttccctccgttcccgtccgtttaccccccgg

SEQ ID NO: 263332 - DNA, 520 bp, Homo sapiens
  misc_feature: GYAE6OF02IRUV7.43.59.F04.1.454.CMB.1.raw
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggccaaagcccccaaactcttgatttatgatgtcacttatcggcctcagggtttctatcgcttctctggctccaagtctggcaacacggcctccctcgaccatctcctgggcctccgacggctggaggaccgaggctgattnttactgacactcacttacaacgccgacactgcgtntcggcggcggacagcgtgtaccg

SEQ ID NO: 263333 - DNA, 747 bp, Homo sapiens
  misc_feature: GYAE6OF02JFRU8.43.59.F04.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
  modified_base (664)..(664): a, c, t, g, unknown or other
  misc_feature (664)..(664): n is a, c, g, or t
  modified_base (699)..(699): a, c, t, g, unknown or other
  misc_feature (699)..(699): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctctgacacgtggaacgtgcaggtgtacggttagaactttancgacctagtcgtcctccgtacgtaaccaactaacgtacccgaggaccaaaccgtacccctaaacttcttaggtaacttttagacgtattacgtactacctttagtcccggttacccttaggttaccgggtttttactttaccggtcttcgtttaccgttcgttacggtccttacgtaaggttcctagggtacccaaccgtacggtcccctttacgaccgaccctacttccgttcggacggtaccgtaccggacgttcgaggtaccgggtacgacggcttagtaattttacggaccttaggaacctaccgtcgttaaccctaacggaaccgaaccttaccgtctttacggacccggttaacgttccggggaaccggtacggaaaccttacgaccgtccgttacccgggttntaaccgggtaccctaggtaacccaccgggttaccncccggttaaccccgtggttacccgtacgttcccgtaccgttccccccg

SEQ ID NO: 263334 - DNA, 719 bp, Homo sapiens
  misc_feature: GYAE6OF02F5JK0.43.59.F04.1.454.CMB.1.raw
tcagtgtgagtagtcacgaccggtgctcgatttagtacacacacttagggagttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcacgtggaagtagcagtgacgttggaacttatcgacctatgtctctggtaccaacaactacccaggacaaacgaccccctaaactccttagatttatgtattgtactactttacgtccggacccttggttacgggtttcttatccgtcttcctcgtcggccttacgtaacgttcgtaggacctaaccgtaccggtccctacccgtcggtaaccctactccgttcgtacgggtcctaccggacggtccgtaggacgggtaaccggtacgggtcctaggtactttacgttaacgtcgtaacctaaccgttacctaaccctttaacgaaaccgtacccggaacttaccggtttagaccggtttaccgttaccggggcggtacccgggaacctaacggtccgttaccggacccggttacccggtgggtaaccctccggacccgtaacgggtcccttacccggtccccgtccggttacccaccgtttcccgtacccggtttcccccg

SEQ ID NO: 263335 - DNA, 725 bp, Homo sapiens
  misc_feature: GYAE6OF02JWWD8.43.59.F04.1.454.CMB.1.raw
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatcctcctgctagtggtaagtagcgagtgtacggttaggaactttagtcgacctagtcggtcctaccgtacggtaaccaaaccgtaaactacccgaacggacctaaaacccgacccccctaaaacgttcgttacgtaacttttacgtacgttaataccggttacctaaccgtttacgtacccggtacccgttacggttacggggtttaccttacgttccgtacctttcggtcgtacggtccttacgtaacgttcgtaccggaccgtaaccgtaccggtcccttacccgtacacccgtacgttacctcgtaccggtcctaccgtacgtcgtaggacggtacggacgtcgttagtatttacgtacgtcgaaccgtaccttacaccgttacgaaccggtacgtaaccttacggtaccgtacgttaaccggtaccgggccggtaaccggtaaccgtacggtcccgtaccgtaacccgg

SEQ ID NO: 263336 - DNA, 711 bp, Homo sapiens
  misc_feature: GYAE6OF02GY186.43.59.F04.1.454.CMB.1.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (372)..(372): a, c, t, g, unknown or other
  misc_feature (372)..(372): n is a, c, g, or t
tcagtgtgagtagtcacgaccggtgctcgatttagtacacacacttagggattgggcacgaccggtgctcgatttagtacacacacttagggattggggggggtctcaggaggcagcgctctcgggacgtctccaccatggcctgggctctgctattcctcaccctcctcactcgaggcacagggtcctgggcccagtctgccctgactcagcctgcctcgtgtctggtctcgtggacngtcgntaaaaacnccatcctctgcactggaatagcagtgacgttagaacttatcgacctagtcgtctccgtacggtaaccaaactaactacccgaggtaccaaaccgcccctaaacgttcttactattttacnggtatcgttactacgttacgtcccggtcccgttaggttacgggttttaccttacgtccggttactttccgtaccgttggtacccttaaccgtacggtttacgtaccggtaccgtaacccggtacccggtacccttacccgttaccgtaacccttacgtttcccgttacggttccgggtccctaccggtacggttccggtaacggacgggtaccgtacgggtccttaaggtaacgtttaactcggtactacccgtaattccgtaacttaccgaaccgtacctaccgttacgtcgtaccgttacgtcggtaccgggaccgtacgaacgtcgacgtacccgg

SEQ ID NO: 263337 - DNA, 538 bp, Homo sapiens
  misc_feature: GYAE6OF02HFRUH.43.59.F04.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (507)..(507): a, c, t, g, unknown or other
  misc_feature (507)..(507): n is a, c, g, or t
tcagtgtgagtagtcacgaccggtgctcgatttagtacacacacttagggattggggggggtctcaggaggcagcgctctcgggacgtctccaccgatggcctgggctctgctattcctcaccctcctcactcagggccacagggtcctgggcccagtctgccctgactcagcctgcctccgtgtctgggtctcctggaccagtcgatcaccatctcctgctactggaatnctagtgacgttggaacttngaccatgtctcctggtaccaacaataccaggcaaacgccccaaactcttagatttatgatgtcacttatcgccctnacgggtttctagtcgtcttctntcggctccagtctgcacncgcctccncncatctcnggcctcaggtctgacgtacgnggctagtattntacgtcgactactactacctaacaccgaccgactacgttgtctagtccggcgcggaacacgtcgcgaccgtctaggtcacggcccgagtccnccgtcccgtcgtacaccgttctcttaccccg

SEQ ID NO: 263338 - DNA, 676 bp, Homo sapiens
  misc_feature: GYAE6OF02H8EQF.43.59.F04.1.454.CMB.1.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
tcagtgtgagtagtcacgaccggtgctcgatttagtacacacacttagggattggggggggtctcaggaggcagcgctctcgggacgtctccacatggcctgggctctgctattcctcaccctcctcactcgagggcacagggtcctgggcccagtctgccctgactcagcctgcctccgtgtcgtgggtcctcctggacagtcgatcaccatcctcctgcacgtggaagtgcagtgacgttgaacttngaccatgtctctgtaccaanactaccgaggacaacgaccccaaactcttagtactttatgaatgtcacttatccgcctacgtagggtttactactcgtcttctcgtcgtactactaacgtctcggacaacgaccgtcctccgtacgacctagtcctcgtcggtccgtaccgacggtcgtacggtacgggaccgaggtaccgtagttaacttaacgttactacgtaacgtaccttaactaacgttaaccgaaaccggaacccgtactaaccgttgtaccgttacggttaccgggccgggtaccggaacccgtaagtcccgtacgtaacccggtaccgttacgggttaccgaccggtaacccgaacggttcccgtacccggtcccccgtaccggttcccgtaaccgttccccgttaccgttaccccccg

SEQ ID NO: 263339 - DNA, 714 bp, Homo sapiens
  misc_feature: GYAE6OF02HSQJ6.43.59.F04.1.454.CMB.1.raw
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcccgcctccgtgtctgggtctcctggacagtcgatcaccatctcctgcactggaatgcagtgacgttggaacttatgacctatgtcctcctggtaccaacaactacccaggacaaacgcccccaaactcttgtactttatgtatgtcacttatccggcctcgaggggtttcttatcgtcttctctcggtctcctaagtcgtcggacaacgtaccggccctcccgtacgaccacttctacgttcgggcctaccgacggtctagggacggacggacggtcgtagtaactttacgttaacgtcgtacctaaacttcctaaaccgttaccgaaaccggtaccgtaaccgttaccgtttacgtacggttaacggttccggggtaccgggtaccggggtaccctaaacgggtccgtaccgggtaccccggtttaccggttaacgggtccgtaacccggtaacccggtaaccgggtcccgtaccccgtaccccccgttacgggtaccccgttacccgtttcccggttaccccgttccccccgttacccccg

SEQ ID NO: 263340 - DNA, 690 bp, Homo sapiens
  misc_feature: GYAE6OF02JXUED.43.59.F04.1.454.CMB.1.raw
  modified_base (223)..(223): a, c, t, g, unknown or other
  misc_feature (223)..(223): n is a, c, g, or t
tcagtgtgagtagtcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtgacgacgtcatccacctgtcctccgngtacctggaaagtggccaaggttgaacgtttggaacttatcgacctatcgtctcctggtaccacaataccagacaacgccccaatccttgattatgtactgtctaccggtacttcggacccggtttcaaggggtttcctagtttctcttcgtcttacggacttccgaggtccaggtccgaacctaccggtcgtaccctcgtaccctacgttcggtctccggggacttccgtacggtaccggtagggacggtacggacggttacttacggtacttacgaactttcgacttaccgacacgtacacgttaccgataccttcgtacgtcggtaccgtaggaccggacgaaccgtccgtaacgggaccctacggttacccgaaggtccccgtacggaaccccgttccggttacccggtccccttacccgggttacctaccccggttccccttccggttccccggtaaccccc

SEQ ID NO: 263341 - DNA, 647 bp, Homo sapiens
  misc_feature: GYAE6OF02H9OF2.43.59.F04.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagtgtgagtagtcacgaccggtgctcgatttagtacacacacttagggattggggggggtctcaggaggtagcgctctcgggacgtctccaccatggcctgggctctgctattcctcaccctcctcactcgagggcacagggtcctgggcccagtctgccctgactcagcctgcctccgtgtctgggtctcctggacagtcgatcaccatctcctgcactggaatgcagtgaacgttggaacttngactntgtctctagtacaacaataccagacaaacgaccccaaattctagtacttttatagtatgtacctattacgtccggcccttcggtacgggtttctttacgtcggtccttcgtcgtacggtccttaccaagttctacggactaacgacccggtcctcccgtacgtaccgtactccgttacgtcgggaccttccgacggtcgtaggaacggacggacgtgtacgtatttactaccgtgtacctaacgtcctaaccttaacgaccgtacgtaacacgtttacgacgtttacggtccggtaccgggaccggtacaacgtcctaccgtaccgttcgtacgtcgaaccggacctaacggtccacccggtcctcggtaccacgttcttcccgtacccgtcccc

SEQ ID NO: 263342 - DNA, 654 bp, Homo sapiens
  misc_feature: GYAE6OF02FZHSZ.43.59.F04.1.454.CMB.1.raw
  modified_base (247)..(247): a, c, t, g, unknown or other
  misc_feature (247)..(247): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtgcagtgacgttggaacttntgaccatgtctcgtggtaaccaacaactacccaggcaaacgaccccccaaactcttgtaatttatgtactcgtcacttactccggtcctcgtagggtttcttatcgtnttctntcgctaccagtctggacacgaccgtcctccgtacgacctctcgtaccgtgggcctccgaggcgtacggacggaccggtacggctagtaactttaattacgtcacctaacttcctaacctaaccgtaaccgaacctactacgttcggtacttacggttcgggacgggaccggaacgtacgtaccgtaccgtaaccggttccgtaacggtaccgaccggtaaccccggtaaggccccgttacccggtcccccgttacggttcccgtaacccgttccgtttccccggttaacccccc

SEQ ID NO: 263343 - DNA, 919 bp, Homo sapiens
  misc_feature: GYAE6OF02HUUNZ.43.59.F04.1.454.CMB.1.raw
  modified_base (264)..(264): a, c, t, g, unknown or other
  misc_feature (264)..(264): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcgaggcacagggtcctgggcccaggtctcgccctgactcagcctgcctcgtgtcgtggtctcctggacagtcgactcgaccatcctcctgacctacgtgggaatcgactagtacggacgttggaactttacgngtaaccctatcgtccttcccgtaggtaaccctaaaccgaacgtaccccgaggaccaaaaccggtaccccccaaaacttctttagtaactttacgtacggtatttccgttacctaacgttttaaccgcccgggttaccccttaaccgggttacggggtttttacccttaaactttcccgggtacctttttccgttacggttacccggggaccttttaaccggaaacggtttcccgttaaccggggaacccgtaaaaccccgggtcccggttacccccgtttaccccgtaaaccggtaaccccgtaaacgttttcccgttaaaccggttcggggtcccgttaacccgggttaacgggtaacccggtacggggtaacgggtaaccggtaagggtaccgtttaacggtaacgttttaacgttaaccggtaacgaaccttaaacggtacctaaacccgttaaaccgaaccggtaaccggtaaccttacggtcgttaccggttaacgttccggggtaccggtaaccgggtaaccaaccgttcgtaccgtaaccggttacccggtcggttaacccgtaccgggtcccgtaaaccggtcccgtaccccggttaccccggttacccgttcccgtacccgttacccgttaccctttaccccccgg

SEQ ID NO: 263344 - DNA, 822 bp, Homo sapiens
  misc_feature: GYAE6OF02JNY1H.43.59.F04.1.454.CMB.1.raw
  modified_base (252)..(252): a, c, t, g, unknown or other
  misc_feature (252)..(252): n is a, c, g, or t
  modified_base (299)..(299): a, c, t, g, unknown or other
  misc_feature (299)..(299): n is a, c, g, or t
  modified_base (808)..(808): a, c, t, g, unknown or other
  misc_feature (808)..(808): n is a, c, g, or t
tcagtgtgagtagtcacgaccggtgctcgatttagtacacacacttagggattgggggggtcgtcaggaggcagcgctctcgggacgtcgtccaccatgcctgggctctgctatcctcaccctcctcactcaggcacagggtcctggcccagtctcgcctgactcacgcctgcctcgtgtctgggtctccgtggaccagtcgatcaccgatctcctgacactggaatacgcaggtctacggttggaaacttncgaccatgtctccgtaggtaccaactaactacccgaggaccaaaacnccccccgtaaactacctttagacttttacgtagtactacgtacctaacttacgtacccggtcccttcggttaacgggggttttcctttaacgttccgtaccttttccgtaccgttcgggtaccctttacccgtaaccgtccgtttacgggaacctaacccggtaaccccgggtccccttccccgttacggtaaacccctacgtttcccgtttcccggtaccggggttccctaccggtaacccgggttcggtaacggtaaccgggtaacgggaacgggttcttaacggttaacgtttacttaaccggttacaacccgttaaccttacccgtaaccctttaaaccggaacccgaaacgtttaccgtaccgttaggttaccggttacccggtttcgggaccgggacggttaaacccaagggtcccgttcggaaccccgttcggtaacggttaccaacccggaccggtaacgtccccgtaccccggtccgtacctacccgtaccggtttcccncccccggttaaccc

SEQ ID NO: 263345 - DNA, 704 bp, Homo sapiens
  misc_feature: GYAE6OF02IEWZ8.43.59.F04.1.454.CMB.1.raw
  modified_base (302)..(302): a, c, t, g, unknown or other
  misc_feature (302)..(302): n is a, c, g, or t
tcagtgtgagtagtcacgaccggtgctcgatttagtacacacacttagggattgggcacgaccggtgctcgatttagtacacacacttagggattggggggggtctcaggaggcagcgctctcggacgtctccaccatggcctgggctctgctattcctcaccctcctcactcagggcacagggtcctgggcccagtctgccctgactcagcctgcctccgtgtcgtgggtctcctaggactacgtcgatccacctactcgtccttgcacttggaacgtagcagtgacgttaggaactttancgacctagtcgtctccgtggtaaccaacgaactcccaggacaaacgcccccaaacttcctgtactttacgtgtacttacgtacctactttcgtacccgtcccgttacggttacgggtttacttacgttcccgtctttccgttcgttacggttccttaccgtaaaggttccgttaacggaccctaacggtacccggtcccgttaccctccgtacccgttaacgttcccgttccgtacgggtcccctaccggtacgtaccggttacggaacgggttaaaccggcggtccgttaaggtaacttttacgttacgtcgtaaccttaccgtcttaaccttaccgaacctaacggtacctacgttcgttacgtaccgttcggcggtccggaatacgccgtacgtacccg

SEQ ID NO: 263346 - DNA, 759 bp, Homo sapiens
  misc_feature: GYAE6OF02G3HWU.43.59.F04.1.454.CMB.1.raw
  modified_base (202)..(202): a, c, t, g, unknown or other
  misc_feature (202)..(202): n is a, c, g, or t
tcagtgtgagtagtcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacngtcgatcaccatcctcctgcacgtaggaagtagcgtagtgacggttaggtaacttacgacgaacctagttcggtcctaccgtacggtaaaccctaaacaacctaacccgaggaaccaaaacccgacccccctaaaacttccttacgttaatttaagtacgtacgttgtaccttaaccttaccgtcccggtccccttacggttaacggggttttccttacgtccgttcctttctcgtccggtacctaccgtaacgttccgtacggaacctaaccgtacccggttcccttcccgtaacgtaccctacgttaccgttcgtccgggtaccctccggacggtccggtacgggtaacgggacggtacggttacgtagttaacgtttacttaccgtactaacctaacctacgttaaccctaacgaaacccgtaccgaaccttgttacggtaaccggttcgtaccgggaccggggacgaaccgtacgtccggtacgtaccgtcggtaaccgtaccgacgaccgacggcctcccgacccggtcttaccgtacctccgtccctaccc

SEQ ID NO: 263347 - DNA, 837 bp, Homo sapiens
  misc_feature: GYAE6OF02FUS1N.43.59.F04.1.454.CMB.1.raw
  modified_base (257)..(257): a, c, t, g, unknown or other
  misc_feature (257)..(257): n is a, c, g, or t
tcagtgtgagtagtcacgaccggtgctcgatttagtacacacacttagggattggggggggggtctcaggaggcagcgctctcgggacgtctccaccatggcctgggctctgctattcctcaccctcctcactcagggcacgagggtcctgggcccagtctcgccctgactcacgcctgcctccgtgtcgtgggtcctccgtggacagtcgatccacatctcctgcacgtggaagtgcgagtgacgttaggaacttncgactagtgtcctcgtacggtaacctaaactaaccgtacccgaacggaaccgaaaccgtaccccctaaacgttcgttacgtaactttagtacgtaacgttcgtacgtaacgttacgtacccggtaccgttacggtaacggggttttccttacgtcgttaccgttctcggttaccggtacccgttacctaacggttcgtccggtaaaccgtaacccggtacccgttcccccgttaccgtacccgggtaaacctccggttacccttcggggtacccgggttccctaacccgggtaggttaacccggtacggggtaacgggtccggtaaacggggtccgttaaacggttaaacgtttacccgttaacgacccgttaaacccgttaaccttaaccttaaccggttaaacccgaaaccgggtaccttaacgtacccgtttcggttaaccgttaacggttcccggggaacgggtaccgaaccggtaaccgtccgtacccggtaccgtaccggttacgaccggttaacgacccggttacgtccggtacccgtccgtaccgtccggtcttacccggtccctacccccg

SEQ ID NO: 263348 - DNA, 682 bp, Homo sapiens
  misc_feature: GYAE6OF02JG477.43.59.F04.1.454.CMB.1.raw
  modified_base (266)..(266): a, c, t, g, unknown or other
  misc_feature (266)..(266): n is a, c, g, or t
  modified_base (272)..(273): a, c, t, g, unknown or other
  misc_feature (272)..(273): n is a, c, g, or t
  modified_base (284)..(284): a, c, t, g, unknown or other
  misc_feature (284)..(284): n is a, c, g, or t
  modified_base (375)..(375): a, c, t, g, unknown or other
  misc_feature (375)..(375): n is a, c, g, or t
tcagtgtgagtagtcacgaccggtgctcgatttagtacacacacttagggattgggcacgaccggtgctcgatttagtacacacacttagggattgggggggtctcaggaggcagcgctcgtcgggacgtctccgaccatggcctgggctctgctattcctcaccctcctcactcgagggcacgagggtcctcgggccctagtccgtcgccctgacctcacgcctgccgtcgtgtcgtgggtcctaccgtgactagtcagtcaccntcctcnncactggaagtncgagtcgacgttcgtaacttgacgtactagtctcctcgtacgacaacactaccgagacctaaccgcccctaatcgtagttattgtacggtntacgtacttaaccgttacgccggttaccttacgggttaacggttttccctaacttccgtcttcgtttacgtcgacgtcgtacgtctcggactaaccgtcgcccgtactaccggtactacctcgtcggtaaccgtccgacgtcgccgtaaggaccggtacgggtactacggtttagtaaccgtttacgtaccgtacaccgtaacgttaacccttacgaacccgtacgaacccgtaacgtacgttaccggtacggttacccgttacggaccggggtacccgtaacggtaccctcggtaaccgtccccgg

SEQ ID NO: 263349 - DNA, 769 bp, Homo sapiens
  misc_feature: GYAE6OF02G66BG.43.59.F04.1.454.CMB.1.raw
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (484)..(484): a, c, t, g, unknown or other
  misc_feature (484)..(484): n is a, c, g, or t
tcagtgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtntctgggtctccnggacagtcgatccaccatctcctgcactagggaatagctaggtgtaacgttgggaaactttagcacctagtcgtctccgtacgtaaccaaactaactaacccaggaccaaaaccgtaccccgtaaaccttaccttagtaatttttagacgtaattcggaaccttacgttacgtcccggtacccgttaggtaacggggttttcttaattccggtacctttcctacgtcggtcctaacctaggttcctcgggaacctaaaccgcccgggaccctttaccccgacgtaaccgtntacccgttcggtaccggtaccgtacccggaaccggtacgtacgggtaaacgggtaccgggacggttccgtagttaagttttaacgttaacgcgttaaccaacgttaacctaactttaaaccgaacccgaacgtacttaacgtccgtacgttacgtcggggaccgggacggaccgaacggtccgtaccggttacccgttacgggtaacgacggaacccgaccgacggacccggttccgtacccccggttccgtaaccgtccggtttcccgttacccggttcccccg

SEQ ID NO: 263350 - DNA, 739 bp, Homo sapiens
  misc_feature: GYAE6OF02GD8EU.43.59.F04.1.454.CMB.1.raw
tcagtgtgagtagtcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtgacagtcgatcaccatctcctgacacgtaggaagtagacagtggtacggttaggtaaacttatacgactattacgtcctcctacgtaaccaacgaactaccgacgacaaacgaccccctaaatcttagtattaatgtattagtctacttacgccggtacccttgtacgggtttctacgttcgtcttcgtcgtacgctacctaagtcgtacgacaacgtccgtaccttacctacgtacctacgtcgtcgtcggaccctacggacgtcgacgggtaacggacggtaggtacttaggttacgtttacgttaacgtacgtaactaacgttacctaaaccgttaacgtaaacccggaaccgtaaccgttacgtttacgggtaccggtttaacggttcccggggtaacccgggacgggttaaaccgaacgggttcccgaccgggttacccggttaccggtaacgtaccgtaacccggaacccgtacgggtccctacccggtcccccggttaccggtacgttacccgttacccgttaccgttaccccccg

SEQ ID NO: 263351 - DNA, 783 bp, Homo sapiens
  misc_feature: GYAE6OF02J0BYJ.43.59.F04.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (520)..(520): a, c, t, g, unknown or other
  misc_feature (520)..(520): n is a, c, g, or t
tcagtgtgagtagtcacgaccggtgctcgatttagtacacacacttagggattggggggggtctcaggaggcagcgctcgtcgggacgtctccaccatggcctgggctctgctattcctcaccctcctcactcgagggcacgagggtcctgggcccagtctcgccctgactcaggcctcgccttcgtgtcgtgggtcctcctaggactaggtccatccacctnttcgtcctgcctacgtgggaatgtcnggtgtaaccggttagaaccttatcgacctatcgtactccgtacgtaaccaactaacgtacccgagaccgaaaccgaccccctaaattcgttagtaagttactacgacttctaccgtacttaccggtcccgtaccgttacggttacgggtttccttaacgtcgttccttaccgcgttcgtacctcgtagttcgacgacaacgccgtacccttccgaacgcctacgtcgtccgaccgggtctcgtaacgtcggaaggtaccggagtaccggtntaaggttactttacgttacgaccgaacccttagtcccgtaaaccgtaaccgtaacccggtaacctgttccgttaacggtacccggtttaacggttacccggggcccgggttaaccggaaaccgtacccggttcgttaaccccggggccgtttaacccgggtacgaaccccggaccggttaacccggacggtttcccccaaccccgggtcccgttaacggttaccccgtacccggtttttcccgtacccccctttaaccccccg

SEQ ID NO: 263352 - DNA, 884 bp, Homo sapiens
  misc_feature: GYAE6OF02INVTE.43.59.F04.1.454.CMB.1.raw
  modified_base (361)..(361): a, c, t, g, unknown or other
  misc_feature (361)..(361): n is a, c, g, or t
tcagtgtgagtagtcacgaccggtgctcgatttagtacacacacttagggagttggggcacgaccggtgctcgatttagtacacacaccttagggattgggggggggtctcaggaggcagcgtctctcgggacgtctccacatggctggctctgctacttcctcaccctcctctactcgacgggcacgtacgggtccgtcgggacccctaggttcctcggccctcgtacctcgacgcctcgccttccgtcgttcgtcgggttctccgtaggacgtacggtcgactccaactcttcctacccgtagtcccgtaaggttacgggaaacgtcacgtgtaacggtacggtaaccgttaactttanaccggttaccgtagttcgtaccgtttaccggaacggtaacctaaccgtaaccgttaccccgggaagggacccctaaaaacccgggtttacccccttaaaaccggtttgtttaacccgttttagtaacccgttacggtttacgttaccgtttaacctaacccgtttacggttacccgggtacccgttttaaccggggtttaaggggtttccctttaacgttcggttccccttaacgtttcccgggttaggtacccgttaccggtacggttaccggtacgtacccgaaccggtaccgtaccctaccgtaccgttaccgttcgtaccgttccggtcggtacccgtacgtaccggacgtaccgggtaacgtacggtagtaccgttacgtacgttacgttacgtaccgttaaaccgtacgttaaccgtaccgtaacccgtaccgtacgtaccggttaccgtacggttacggttccgggtacgtaccggggttaaccgacccggtaacggttcccgtacggttacccgg

SEQ ID NO: 263353 - DNA, 482 bp, Homo sapiens
  misc_feature: GYAE6OF01C95HG.13.73.G07.1.454.CMB.1.raw
  modified_base (471)..(482): a, c, t, g, unknown or other
  misc_feature (471)..(482): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcgtccgtcagggatttccactcgcttctctggctccaagtctggcaacacggcctccctgacaatctctggtctccaggctgaggacgaggctgcctattactgctgctcatatgcaggtttcttctgtggtcttcggcggagggtccaaagtgaccgtcctaggtcagcccaaggctcgccccctcggtcactctcgttccccgccctcctctagtacgtgactgagcgggctggcaggcgcatagnnnnnnnnnnnn

SEQ ID NO: 263354 - DNA, 504 bp, Homo sapiens
  misc_feature: GYAE6OF01BHCYM.13.73.G07.1.454.CMB.1.raw
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggcaataagcggccctcagggctttctgatcgcttctctggctccaagtctggcaacacggcctccctgacaatctctggactccaggccgaggacgaggctgtatttttacngcagctcatatacagcgcagctctctttanctcttcggagtcggaccaggtcaccgtctagtccagcccaaggcccaacccatctcnctccg

SEQ ID NO: 263355 - DNA, 527 bp, Homo sapiens
  misc_feature: GYAE6OF01DC67M.13.73.G07.1.454.CMB.1.raw
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttggacttatgaccttgtctcctggtaccgacaacacccaggacaaacgcccccaaaatcatttatttaacggggtcaataacgcggccctnagggtctttctgatcgcttctctggctcaagtctggcaacncggcctcctagacaatctctggacctccgaggccgaggacgaggctagtatttttacgngtttgtcattangacgaggaagngtagtattattgtcgttgaagtggactagtcaccgtcttggcagacccaaggcccaccctatgtacatcctgttcccgtccc

SEQ ID NO: 263356 - DNA, 514 bp, Homo sapiens
  misc_feature: GYAE6OF01BIUD6.13.73.G07.1.454.CMB.1.raw
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggccctccctgacaatctctggactccaggcccgagggacgaggctgatttttacngtttgttcatatgcaggaaggngtgattntgttctttggagtggacaggtcaccgtcttggtcagccaggcccaacccactgcatctcgtcccgtcccc

SEQ ID NO: 263357 - DNA, 536 bp, Homo sapiens
  misc_feature: GYAE6OF01ADII3.13.73.G07.1.454.CMB.1.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattattacgggtcaataagcggccctcagggctttcngatcgcttctctggctccaagtctggcaacacggcctcccngacatctctggtctccaggctgaggacgaggctgcctatactgctgctcatatgctaggttcttcgtgttggtcgttcggcggtaggtccgaaaggtcgaccggttcctagggtcacggtaccccgaacggtcctcggtcccccctggtccctaccgttccgttccccg

SEQ ID NO: 263358 - DNA, 645 bp, Homo sapiens
  misc_feature: GYAE6OF01DSBEH.13.73.G07.1.454.CMB.1.raw
  modified_base (221)..(221): a, c, t, g, unknown or other
  misc_feature (221)..(221): n is a, c, g, or t
  modified_base (363)..(363): a, c, t, g, unknown or other
  misc_feature (363)..(363): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatgttgggacttatgaccttgtctcctggtaccgacaacaccagcaaacgcccccaactcattagttacgggtcaataacgccggccctcgacgggtctttctgactcgcttctctggctccaagtctggacaacncggtcctccctgacaatctctcggactccgaggccgaggacgaggtctagtatttttactgtttagttcattagtgacgtaagggtaaggtagttagtatttagttggttcgtttaggggaacggttcggggaccctaaacgggttccctaaacccggtttcccgtttagggtacccgtaaccgggaacccccgtaaacgggacccccctaaaaccccccgtcgttaccggtccctaacgtttcccgtttacccggtttccccccgtcccccgtttaccccg

SEQ ID NO: 263359 - DNA, 787 bp, Homo sapiens
  misc_feature: GYAE6OF01A8MEJ.13.73.G07.1.454.CMB.1.raw
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactaggaaatgcagtgatggttggacttatgaccttgtctcgtggtaccgacaacacccaggacaaacgcccccaaactcaatttacgtttacggggtacaagtaacgcggaccctacgacgggtctttacgtgtactcgtccgtttcttcgtcggtccttacccgtaaacggttccttcgggacctaaaccgtaccgggtaccccttcccgttacggtaacctaaacttccttacgttacgggaccttacccgacggggtaccccggaacggggtaccggacgggtacctttacggtttaacgtttttttaaccgttcggttttacggtttaacgtaacgtttaacgtcggtaacggttaaacggggtaagggtaaggtttaggtaagttttaagtttcgggtttaccgttttaggggaacgggttacggggtaacccggtaaacgggttccggtaaccccggtttaccggtttacgggacccttaccggaaccccgtaaaccgggacccccttaaaccccccgacgtttacggtacccgtaacgttccccgttccggtttccccccgtacccccgg

SEQ ID NO: 263360 - DNA, 487 bp, Homo sapiens
  misc_feature: GYAE6OF01COLTV.13.73.G07.1.454.CMB.1.raw
  modified_base (328)..(328): a, c, t, g, unknown or other
  misc_feature (328)..(328): n is a, c, g, or t
  modified_base (413)..(413): a, c, t, g, unknown or other
  misc_feature (413)..(413): n is a, c, g, or t
  modified_base (475)..(487): a, c, t, g, unknown or other
  misc_feature (475)..(487): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggtctttctgatcgcttctctggctccaagtctggcaacacggcctccctgacaatctctggactccaggccgaggacgaggctgtatttttacngtttgttcatatgcaagggaaggagtgtattatgtctttggaagtgggaccaaggtcacgtctggtcagcccaaggcccaacccntgtcactctgtccccacctctctagtactgactggagcgggtctgggcaaggcacagtacgnnnnnnnnnnnnn

SEQ ID NO: 263361 - DNA, 521 bp, Homo sapiens
  misc_feature: GYAE6OF01BACMC.13.73.G07.1.454.CMB.1.raw
  modified_base (400)..(400): a, c, t, g, unknown or other
  misc_feature (400)..(400): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacgggaacacagactatggacagaacctccagggcagatcaccatgacgacagacacatacacgaacacagcctanatggaggtgaaggagcctgagagtatagaccgaacaccgggccgttgtattagttgtgcggagtaggtgggagtgggctaggtaggtatagtacgaactaaatttactaattaagttaacg

SEQ ID NO: 263362 - DNA, 629 bp, Homo sapiens
  misc_feature: GYAE6OF01CQ5RK.13.73.G07.1.454.CMB.1.raw
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttaccacctttagcagctatcttancagctgggtncgacgaggcccctggacgaggactcggagtggatgggatggatcgacgacccttaacgaacggaaaacncgaagactaagtacggaacaacgaacctccgagggacaggacttcaacatacgacgacagacanactaacacgaacacacgacctanagtacggaggtagaggtacaccgtagaagtagtagtacgaaccgaacgtaccgggtccgttagttaactttagttaggtcggtaccggagggttaggtaggggtaacgggtgggaccggtaagggttacgggtaaacgttacgttaccggtaaaacgttaaaacgttttaacttaaacccgtttaagtttaaaacccggg

SEQ ID NO: 263363 - DNA, 563 bp, Homo sapiens
  misc_feature: GYAE6OF01DEJB4.13.73.G07.1.454.CMB.1.raw
  modified_base (221)..(221): a, c, t, g, unknown or other
  misc_feature (221)..(221): n is a, c, g, or t
  modified_base (330)..(330): a, c, t, g, unknown or other
  misc_feature (330)..(330): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcttgggacttatagtacttgtctcctggtaaccaacaccaccaggccaacggcccccagagtcatcatttagtggggacaagtaggcggccgtgagggtnttccactcgcttctcgtcggctccaagtctggacaaacgcggtccctccctagacctaactctcgtcggtcctcgaggtctaggaggacgaggctcgccttattacgtgtctgctcatatcgtcgtagttcttcgtgttcggttcgtcgggcggtaggtacctaaggtcgaccgttcgtaggtacacggtacccgaacggtccgtaccgtcccccgtcggtccctcgttcccg

SEQ ID NO: 263364 - DNA, 809 bp, Homo sapiens
  misc_feature: GYAE6OF01C96R6.13.73.G07.1.454.CMB.1.raw
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgtcctgactcagcctgcctcatgtctgggtctcctggacagtcgatcaccatctcctgcactggaaatgcagtgatggtggacttatgaccttgtctcctaggtaccgacgaaccacccaggaccaaacgcccccaaatcaattacgtttacgggacaaagtaacgccggccctacgagggtctttctgactcgcttctctcggactccaagtctacggacaaccgtaccggtccctacccgttagaacctaaattcccgtacgtaccgggtacctacccggaacggggacccggaacgggtaaccggtacgggtacgttaggtttaaaccgtttttttaacgttcgggttttacgtttaccgtaagtttaacgtacggtaaccgtaaaggggttaaagggtacggttaagttaacggttttaacggtttacgggttttaacccggttttaagggggaaacggtttaccgggggtaaaacccttaacgggggtttaccctaaccccggggtttaccgtttaaccggggtaccgtaaaccccgggtacccccggttaaaccggggtaccccccctaaaaccccccgttaacggttacccggtttacccgtaaccccgttttacccgtttaccccgggtacccccctttaaacccccccgg

SEQ ID NO: 263365 - DNA, 682 bp, Homo sapiens
  misc_feature: GYAE6OF01ALOZV.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaatagcagtgatggttgggacttatgtaccttgtctcctggtaccgacaacacccaggacaaacgcccccaaactctatttattacgggtacaagtaacgccggccctcgagggtctttctgtattccgtctttctcgtcggccttacccgaagttccgtacgggaccaaccgtaccgggtccccttacccgtagacctaatccgtacgtcggacctccgaacggccggaggacggagtcttagttattttacgtgtttgttacattagtggacgtaagggaaggtgttaggtaatttagttaggttcgtttaagggtaacggttacggggaacccgttaagggttcctacccggttccgtttacggggtacccaaccgggaaccccggtaacggaccccccgtaaacccccgtacgttaccggtcccttaaccgtttccctacccggtttcccccccttaccccg

SEQ ID NO: 263366 - DNA, 515 bp, Homo sapiens
  misc_feature: GYAE6OF01C7AKZ.13.73.G07.1.454.CMB.1.raw
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (496)..(496): a, c, t, g, unknown or other
  misc_feature (496)..(496): n is a, c, g, or t
  modified_base (500)..(515): a, c, t, g, unknown or other
  misc_feature (500)..(515): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggccccagagtcatcatttagngggggcaagtaggcggccgtcgagggtatttccactcgcttctctggctccaagtccgtggacaacacggcctcccngacaatctctggtctccgagcctggacggacgaggctgcctaattctgctgctcatatgcaggttcttcgtgtggtcttcgggngtacgggtaccaaaggtcgaccgtcgtacggtcacgccgaaggtccncggtcccctacgggtcctacgtctccgtcccncctcctntacgtcgtgtactcgagtcggctggacgaggtcgatanacgnnnnnnnnnnnnnnnn

SEQ ID NO: 263367 - DNA, 625 bp, Homo sapiens
  misc_feature: GYAE6OF01A6DCU.13.73.G07.1.454.CMB.1.raw
  modified_base (325)..(325): a, c, t, g, unknown or other
  misc_feature (325)..(325): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaatgcagtgatgttggacttatgtaccttgtctcctggtaccgacaacaccagacaacgccccaactcattagttacgggacaagtacgccgcctcgaggtctttcngatcgtcttctctggctcgaagtctaggaccaacgaccggtccctaccctagaactactctcgtacggacctccgacgggaccgaggacgtacggtcttagtttacttttacgtggtttagttactatttacgtggacgaagggtaaggtagttagtagtttagttaggtttacggtttaaggaacgggttacgggaaccgtaacggtccgtacccggttcgttaggtccgtacgacccggaacgaccccctaaacccgcgttacgtaccctaaccttccgttcccgttccccctacccg

SEQ ID NO: 263368 - DNA, 614 bp, Homo sapiens
  misc_feature: GYAE6OF01AU8GK.13.73.G07.1.454.CMB.1.raw
  modified_base (439)..(439): a, c, t, g, unknown or other
  misc_feature (439)..(439): n is a, c, g, or t
tcagtcacgtactacacgaccggtgctcgatttagctctacgctcaggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattatttacgggtcaataagcggccctcagggtctttctgatcgcttctctggctcaagtctggcaacacggcctccctgacaatctctggactccaggccgaggacgaggctagtatttttactgtttgttcatatcgacaagggtaagngtagtatttaagtggttaccgttttagggaaggttacggggaaccctaagggttacccgaaccccggtttccgtttacgggtacccgacggtacccccgtaaacgggaccccctaaacccccgtacgttccgtacccgtaaccgttcccgttccggtttccccccggtacccccc

SEQ ID NO: 263369 - DNA, 631 bp, Homo sapiens
  misc_feature: GYAE6OF01EMYPF.13.73.G07.1.454.CMB.1.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgattgttgggacttatgaccttgtctctggtaccacaacacccaggcaaacgacccccaatcattatttacggggacaataacgcgccctnagggtctttcgtgatcgcttntcgtggctcaagtctggaccacgaccggcctcctcgactaacttcctcgtgacctccgacggtccggaggtaccggaggtccttgtacttttttacgtgtttacttcgtattagtgacgaagggtaacgtaggttagtactttagttggtttacgtttaagggtaacggttacgggaacctaacggttccgtaccggttacgtttcgggtaccgacggtacccgaacggtccccgtaccggtccccccgttacgggtcctacccgtttccgttcccgttcccccgttacccccg

SEQ ID NO: 263370 - DNA, 822 bp, Homo sapiens
  misc_feature: GYAE6OF01DESJ1.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctctggacagtcgatcaccatcctcctgcacgtaggaaactagcagtgagttggttagggtacttagtgtaccttgtcctcgtacggtaccgaacaaccaccgaggaccaaaccgaccccctaaactcttaacgtttaacggtttacggggtactaaacgtaacggccggtaccctacggtacgggtcctttacgtcgtacgtccgtcctttctcgtcggtaccgtaaccctaacggtccgtaagggaccctaaaccggtacccgggtcccttaccccgtacggtaaacctaaacgttcccgttacggttaccggtaacccgttacccgggaaccgggtacccgggaacggggtaaccggtacgggtacctttaggttttaaccgttttttacgtgttttacggttacctagttagttacgggaacggtaaggggtaacggtaagttacgttaagttttacgtttacgggttacggtttagggtaacgggttacgggtaacccggtaacgggttaccccggtaacccgggtttcgttaccgggttaaccggaaccgtaaccccggtaaacccggtacccctaaaccccctcggttaccgtaacccttaccgttcccggttcccgttcccccggttacccc

SEQ ID NO: 263371 - DNA, 528 bp, Homo sapiens
  misc_feature: GYAE6OF01E2H7B.13.73.G07.1.454.CMB.1.raw
  modified_base (481)..(481): a, c, t, g, unknown or other
  misc_feature (481)..(481): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggtacactttagcagctatcttatcagctgggtgcgacacggcccctggacgaggactcgagtggatgggatggatcgagcccttaacaacggaaacacgagactatggacagaacctcgaggcagactcacatgacgacagacacgatacacaacacagacctacagtcggaggtgaggagctgagatagtgacgacgacggtccgtgtattagtgtggcgtaaggaggtggacggtgggacgngggtaggtaagtacgtacggaactaaatttacttaacgtagttaacg

SEQ ID NO: 263372 - DNA, 604 bp, Homo sapiens
  misc_feature: GYAE6OF01DSHH9.13.73.G07.1.454.CMB.1.raw
  modified_base (240)..(240): a, c, t, g, unknown or other
  misc_feature (240)..(240): n is a, c, g, or t
  modified_base (333)..(333): a, c, t, g, unknown or other
  misc_feature (333)..(333): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacgcagtgatggttggacttangtaccttgtctccgtgtaccgacaacaccaggacaacgccccaactctatttacgtttacgggacaaagtacgccggcctcgagggtctttcngactcgcttctctgctcagtctgcacgacgcctcctgacatctcgtgacctcgacggccgaggacgagtcttagttacttttacgtgttcgttacattagtcggtacaagggtaaggtatacgtaatttagtcggttgtttagggaacgtgggtaaccgtaacggttcctaccggttcgttacggtccgaaccggacccaaacggtcccccaaaccgtccttacggtaccctaccgttccgtttaccggttccccccgtcccgtttacccg

SEQ ID NO: 263373 - DNA, 696 bp, Homo sapiens
  misc_feature: GYAE6OF01BUY4A.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatccaccatctcctgcactggaaatgcagtgatggttggacttatgtaccttgtctcctggtaccgacaacacccaggaccaaacgccccaaactcattacgttacgggacaagtaacgccggtccctcgtacgggtctttcgtcgtactcgtcttcgtctcggtcctaccgaagtcctcggaccaaccgaccggtaccctcccgtagaacctaactccgtcgtacggacctaccgacgggccgaagggtaccgacggtcttacgttaactttttacgtgtttcgttactagttagtacggtacggaacgggtaaggtaggttacgtagttttagttacggtttacggtttagggaaacgggttacgggaacccgtacgggttacccgtaccggttaccgtttacgggtaccctaacggaccccgtaacgggtacccccctaaaccccgtaccgttccgtacccttaacccgttccgttcccgttccccccgtaaccccg

SEQ ID NO: 263374 - DNA, 520 bp, Homo sapiens
  misc_feature: GYAE6OF01E4OUE.13.73.G07.1.454.CMB.1.raw
  modified_base (325)..(325): a, c, t, g, unknown or other
  misc_feature (325)..(325): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacacggcccctggacgaggactcgagtggatgggatggatcagcccttaanaacggaaacacagactatggacagaacctccgagggcagacttcaccatgacgacacgacacatacacgaacacagcctacagtggaggtgaggacgccgtagagatagtagacgacgtaccggcgttagtattagttgtgcgagagtggagtggactgtggatagtacgaactaaattacttacgtagttaacg

SEQ ID NO: 263375 - DNA, 672 bp, Homo sapiens
  misc_feature: GYAE6OF01CS56E.13.73.G07.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (649)..(649): a, c, t, g, unknown or other
  misc_feature (649)..(649): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (665)..(670): a, c, t, g, unknown or other
  misc_feature (665)..(670): n is a, c, g, or t
  modified_base (672)..(672): a, c, t, g, unknown or other
  misc_feature (672)..(672): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcgttgggacttatagacttgtctcctggtaccaaccaccacccaggcaacggccccagngtcatctatttagngggggcaagtagggcggtccgtgagggtactttccactcgtcttctcgtggctccgaagttctaggacaacgtaccggccctccgtagacacttctcgtcggtcctccgtaggcgtaggacgggacggacggtctcggacctttattacgtgactgtacctcgtaatcgttacgtcgttaggttttcctttcggttcggttcggttccggttcgggtacgggacggttacgtaacgggtccgtaaccggttccgtaaggtccgaaccgcccgtaaggtcccgtacccggtccccgtacggtccctaccgtttccgttacccctacccccgttaacccctttcccgtaacgtttaccggtaccggttacggtacccttaggggccgggtaccgggtccgtaccgggaacgtacggggttccgacgtaagtcgacngatcgatcgngngngnnnnnngn

SEQ ID NO: 263376 - DNA, 553 bp, Homo sapiens
  misc_feature: GYAE6OF01EB4E5.13.73.G07.1.454.CMB.1.raw
  modified_base (212)..(212): a, c, t, g, unknown or other
  misc_feature (212)..(212): n is a, c, g, or t
  modified_base (508)..(508): a, c, t, g, unknown or other
  misc_feature (508)..(508): n is a, c, g, or t
  modified_base (533)..(533): a, c, t, g, unknown or other
  misc_feature (533)..(533): n is a, c, g, or t
  modified_base (536)..(537): a, c, t, g, unknown or other
  misc_feature (536)..(537): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (548)..(553): a, c, t, g, unknown or other
  misc_feature (548)..(553): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaacggccccagagtcatcatttagngggggacaagtagggcggccgtcgagggtactttccactcgcttctctggctaccaagtcgtggcaacaccggcctccctgacatctctggtcctccgaggctggacggacgaggctgccttattactgtctgctcatagtcgctaggtttcttcgtggttcggttcgtcgggcggtacggtaccaaggtcgtaccgtcgtaggtcgacgacccgaggcctccgtccccgtcggtcctaccttccgtccgtcccctcccgtccttcgtacgtcgtgtaccgtcggacggtccgggntcgggacgacggcgacgtagtacgntgnngcngntcgncnnnnnn

SEQ ID NO: 263377 - DNA, 819 bp, Homo sapiens
  misc_feature: GYAE6OF01EEDF8.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctcgccctgactcacgcctgcctccatgtcgtcgggtctccgtggacagtcgactcaccatctccgtgctacgtaggaaatagctagtgtagttggttaggtacttagtcgttaccgtttcgtccgttccgtacgggtaacccgaaccaaccaacccgaacgggaacccaaaacccggtaccccccctaaaacttccgttaaacgttttaacggtttaaccgggggtaactaaacgttaaccggcccggtaccctacgggtacgggttctttcgtacgtactccgtcttccgttcgtaccggtcctacgtaacgtccgtcggaaccgaaccgtacccgtacccttcccgtagtaacccgtaacttccgtaccggttaccggtacctacccgggaccgggacggtaaccggggtaaccggtacggttccgtttaacggttttacttttttaccggttacggttttcgttaaccgtatttaacggtcggtaacggtaaggggtaagggtacgttagttaagtttacggttcggtttacggttaggtacgggtaccggtacgtaacggttcccgtacccgttcggttccggtcgaacccggtccccgtaaacgacccccgtacccgtacgttccgtaccgtaccgtttcccgttccccgttccccgtaccccg

SEQ ID NO: 263378 - DNA, 578 bp, Homo sapiens
  misc_feature: GYAE6OF01A7YTE.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgtaccttgtctcctggtaccgacaacacccaggaccaaacgcccccaaactctattagtttacggggtcaagtaagccggccctcgtacggttttctgtactcgtcttctctcgtcctaccaagtctggacaacgacgcctcctacgacctatcgtcgtcggctcgaggtctggacgagtgagtctagtatttacttacgtgtctcgactctattacgtgacgacgtcgacgtactacgtatacgtacgtaggtccggacgggacggaccgaacgtcttacggtacccgttacgttacggccgtacggccccgaaggtcccgtccgtcccccgtaccgg

SEQ ID NO: 263379 - DNA, 654 bp, Homo sapiens
  misc_feature: GYAE6OF01D1AOI.13.73.G07.1.454.CMB.1.raw
  modified_base (223)..(223): a, c, t, g, unknown or other
  misc_feature (223)..(223): n is a, c, g, or t
  modified_base (320)..(320): a, c, t, g, unknown or other
  misc_feature (320)..(320): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtaggaaacngcagtgattcgttgggacttagtagtacttgtcctccgtaggtaaccaaccacccaccgaggaccaacggcccccagacgtcatctaagtttacggngggggacaagtcgggccggtaccgtagagggtacttccacgtcgtctttcgtcgtcggctaccgaagtcgtacggacctaaccgaccgtccctcccgtagaacctaacgttctcgtgtcctccgacggtctaggacggacgaggtcctacgtaccttacttaccgtgtacgtcgtctactagtacgtcgtacgttaggtttccttcgttcggttcgttcggttaccgggtcgggtaacgggtaccgaaaggttccggtaccgttaccgtaggtcctaccggtacccgaacggtcccgtaccccgtcccccgttacggttcccgtaccgttcccg

SEQ ID NO: 263380 - DNA, 703 bp, Homo sapiens
  misc_feature: GYAE6OF01DA5U5.13.73.G07.1.454.CMB.1.raw
  modified_base (466)..(466): a, c, t, g, unknown or other
  misc_feature (466)..(466): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatggttgggacttagtcgtaccgttgtcctccgtacggtaccgaaccaaccacccgaggaccaaaccgacccccaaactctaagttacgttaacgggtacaaagtaacggccgtccctagacggtcttcgtgtactcgtcttctcgtcggctaccgtaagtccgtagaccaaccgtcggtcccctccgtacgaactaacgttcgtaccgtacggacctccggacgggtccgaggaacggngtaccttagtttacttttacgtgtttacgttactaagttagtacggacggtaagggtaacgggtatacggttaatttaggtacggtttacggtttagggtaacggtacgggaaccgtaacgggttccctaccggttccgtttacggaccgtaaccggaccccgtaaccgggaaccccctaaccccgttacgttcgtaaccccttaccgttccccgttcccggtcccccggttccccc

SEQ ID NO: 263381 - DNA, 727 bp, Homo sapiens
  misc_feature: GYAE6OF01EFZKR.13.73.G07.1.454.CMB.1.raw
tcagtcacgtactacacgaccggtgctcgatttagctctacgctcgagggggggggtcacaagaggcagcgctctcgggacgtctccaccatggcctgggctctgctgctcctcactctcctcactcaggacacgagggtcctgggcccagtctcgccctgactcacgcctcgcctccatgtccgtgggttcctccgtggacaggtcgactccaccactcctcctgcacgtaggaaatagcagtgtagttggttaggtacttatcgtaccttcgtcctccgtacggtaccgaaccaaccaccgaggaccaaccgaccccctaaatctaagtttacggttaccgggtacaaagtaccggccgtaccctcgtacggttcctttacgtcgtacgttccgtcttctcgtcgtcctacgtaagtcgtcgaaccacgccggtccctacgtagaactacgtcctacgtcgaccgtaccgacgggaccggaggaccggtggtacttgtttaacttttacgttgttacgttactagttacgtacggacggtaagggtaaggttacggtagtttaacgttaggtttacggtttacggttacgggtaagggttaccgggtaaccggttaacggttcccgttacggttaccggttacggacccggtaccggaaccccgtaccggaccctaacccgtacgttcgtaccgtacccttcccgttcccgtaccccgttacccg

SEQ ID NO: 263382 - DNA, 848 bp, Homo sapiens
  misc_feature: GYAE6OF01BWOWU.13.73.G07.1.454.CMB.1.raw
tcagtcacgtactacacgaccggtgctcgatttagctctacgctcgaggggggggtcacaagaggcagcgctctcgggacgtctccaccatggcctgggctctgctgctcctcactctcctcactcaggacacgagggtcctgggcccagtctgccctgactcagcctgcctcatgtctgggtctccgtggacagtcgatcaccatctctgcactaggaatagcagtgagttggttggacttagtcgtaccgttgttccgtaccgtacggtaccgaaccaaccgacccgaacggaccaaaaccggaccccctaaaacttactaacggttttaacggtttaccggggtaactaaacgtaaccggtccggtacccgtacgtaacgggtttctttacgtacggtacttccggtcctttacgtcgttacggtacctaccgtaagtcgtacggtaccgaaccgtccggtacccttaccgtacgaacctaacttcgtacgtacggtaccgttacccggaacgggtaccggaacgggtacggtacgtacgtttacggtttaactttttacgttggttttacgtacgttaacgttaacgttcggtaacgggtaaagggtaagggttaacggtttaacgttaacggtttaggtttacgggtttacgggtttaacgggtaacggggttaccggaaacccggtttaaaccgggttacccgttacccgggtttacccgggtttaacggtacccggtaacccggtaaccccggttaaacccgaacccccggttaaaccctaccggtttacccgtacccgttacccgtttacccgttcccccgggttacccccgttaccccg

SEQ ID NO: 263383 - DNA, 612 bp, Homo sapiens
  misc_feature: GYAE6OF01CGDQ0.13.73.G07.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (602)..(612): a, c, t, g, unknown or other
  misc_feature (602)..(612): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctgtaccaacaccaccaggcaacggccccagagtcatcatttagngggggacaagtagggcggccgtcgaagggtntttccactcgcttctcgtggctccaagtctggacaacgacggcctccctagacactctcgtcggtcctccgaggctggaacggacgnggctcgaccttattacgtgctcgtctctatatcgtacgttaggtttcttcgttcggttcggttccgttcgggtacgggtaacgggttaccgaaacggttccggtacccgttaccggtacggtccgacgtacccggtacggtcctaccggtcccccgtacggtcctaccgttccgttcccgttacccctaccccttccgttaccgttacgttaccgtcgtacgtacggtacgggtcgggcgtacggacggacggcgtcgagtccgtagngcgncnnnnnnnnnnn

SEQ ID NO: 263384 - DNA, 696 bp, Homo sapiens
  misc_feature: GYAE6OF01B73BO.13.73.G07.1.454.CMB.1.raw
  modified_base (488)..(488): a, c, t, g, unknown or other
  misc_feature (488)..(488): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcgaggtgaagatctcctgacaaggtcttcgtggtttacaccgttttagctaagtcttactcctttatccagtcgttagggcgcgacgaccggccccgtagggacggtaggcttcggaacgtggagtggggataggtatccgacgtaccccgttaagaaaaccggaacacgaagtaacgtagaacggaacaacgaacccgtcgaagggacgtagtacttacgactaggtacgaaccacagaacaacgataaaccgacgaaactacgaacgtacctaanacggtacgggaaggtcggaaggtacgtaccgtaggtaacgtaagtacgtaacggaaccgaacgttaccgggtaccggttaattaaccgggttagttacgggtacggtacgggacggtaagggttacgggtaggtaccgggtagtagggtaacggtaacttaacggtacggtaaacttaaatttaccgttaaacgttaagtttaaacgg

SEQ ID NO: 263385 - DNA, 658 bp, Homo sapiens
  misc_feature: GYAE6OF01DF4GJ.13.73.G07.1.454.CMB.1.raw
  modified_base (325)..(325): a, c, t, g, unknown or other
  misc_feature (325)..(325): n is a, c, g, or t
  modified_base (570)..(570): a, c, t, g, unknown or other
  misc_feature (570)..(570): n is a, c, g, or t
  modified_base (586)..(586): a, c, t, g, unknown or other
  misc_feature (586)..(586): n is a, c, g, or t
tcagtcacgtactacacgaccggtgctcgatttagctctacgctcaggggacccgaaaaaccacacccctccttgggagaatcccctagatcacagctcctcaccatggactggacctggagcattcctttttctggtggcagccagcaacaggtgcccactccccaggttcagctggtgcagtctgcagctgaggtgaaagaagccgtggggcctcagtagaagattctcctgcaggtcttctaggttacactttgacagtctatcgttatcagtcgtagggtcgcgaccgtacggcccccgtaggaccgacggaccttacggngttagggacggtagggacgtggagttccgaccgtacccgttaacgaaaaccggaaccacgtaagtacgttaagacgtaacgacgaacccgtcgaagggactaggacttaccaaccgagtcgaaccgtacaacgacaccgtaactaacgtaaccgaactacgacggtacctacggtacgtgggaacggtaggacggtaacgccgtagaagagtacgtacgaccgacggtacgtcgttagttagttnttgggacgaggacggnggttagggattccgggagtaggacggtattaacgtacgttaaactaaaccgttttagtaacttagttaaccg

SEQ ID NO: 263386 - DNA, 639 bp, Homo sapiens
  misc_feature: GYAE6OF01D3NID.13.73.G07.1.454.CMB.1.raw
  modified_base (326)..(326): a, c, t, g, unknown or other
  misc_feature (326)..(326): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgcagtgatggttggacttatgacttgtctcctggtaccgacaacaccaggacaaacgccccaaatctattagttacgggacaagtaacgcgcctcgagggtctttcngtatcgtcttctcgtcggtcctaccgaagtcgtacgacctaaccgaccggtcccttcccgtagaacctaagtcctcgtacggacctccgacgggccgaagggacgaggtcttagttactttttagtgtttacgttactaattacgtagacgtaagggaaggtagtagtaagtttagttcgttacggtttaagggacggttacgggaaccgtaacggtccgtacccggttcgttcggtaccgacggtacccgaacggacccctaacccctacgttcgtacctaccgtttcccgttccgttaccccttaaccccg

SEQ ID NO: 263387 - DNA, 659 bp, Homo sapiens
  misc_feature: GYAE6OF01CFWPB.13.73.G07.1.454.CMB.1.raw
  modified_base (235)..(235): a, c, t, g, unknown or other
  misc_feature (235)..(235): n is a, c, g, or t
  modified_base (590)..(590): a, c, t, g, unknown or other
  misc_feature (590)..(590): n is a, c, g, or t
  modified_base (650)..(650): a, c, t, g, unknown or other
  misc_feature (650)..(650): n is a, c, g, or t
tcagtcacgtactacacgaccggtgctcgatttagctctacgctcgagggggggtcacaagaggcagcgctctcgggacgtctccaccatggcctgggctctgctgctcctcactctcctcactcagggccacaggatccgtgggcctcagtctgcccctgactcagcctcgctcaggtgtcccggtctccgtggacagtcacgtcaaccatctcctgactacgtacggaaaccnggccaggtgacgttggttaggttaggttataacttatgtccgttaccgtaggtaacccaacaaccaccgaacggaaccaaaaccgtacccccaaaagtcagttacgtaatttagagtatagtacgtaacgttaacgccggtacccgtacggtaaccgggtcctacgtacgtcgttccttcgtctccgtaccgtaacgtaagtccgtaccggtaaccaaccgtcccggacccttaccgaccgtaccctaacgttcgtccgttcgggacctaccggtacggtccgagtaacggtcgtacgtaacgttgtttagtactttacgtacgtcttacgtacgtaccttagtagtactcgganacggtcacgtactacgcgttacgtacgtacgtcggacgtacgcagtcgacgttcagcganccgtaaccg

SEQ ID NO: 263388 - DNA, 635 bp, Homo sapiens
  misc_feature: GYAE6OF01CS8OC.13.73.G07.1.454.CMB.1.raw
  modified_base (444)..(444): a, c, t, g, unknown or other
  misc_feature (444)..(444): n is a, c, g, or t
  modified_base (478)..(478): a, c, t, g, unknown or other
  misc_feature (478)..(478): n is a, c, g, or t
tcagtcacgtactacacgaccggtgctcgatttagctctacgctcagggacccaaaaaccacacccctccttgggagaatcccctagatcacagctcctcaccatggactggacctggagctattcctttttcgttggtggcagcagcaacaggtcgcccactccaggttcagcgtggtgcagtctgcagctgaggtgaagagccgtggggcctcgagtgaagtctcctccgtagacgaaggtcttcgttacggttacctaccgtttagcagtcttatcttagcgagtcgttggcgacgtacgccggcccgtggaacggagtcgtcggagtcggagtagggatcggatacgacgacctaacgaacggaacagacgtagtagaggaacgaacgaccgtacggaggcaacgtctaacgactaggtacacgtacagtaacacgtaanaaccgacgaacaacgctacctagaggtgggaagngaacgtagacagaagtataggacgtacgaccggtacgtcgttagttaacttgggtgaacggtgaaagggttaggcgggtaccgtaggggctaagggttacgtaacgtaacgttaacgaaacccgtttaaattaacccgttagttaaacgttaacggg

SEQ ID NO: 263389 - DNA, 664 bp, Homo sapiens
  misc_feature: GYAE6OF01CM2LO.13.73.G07.1.454.CMB.1.raw
  modified_base (121)..(121): a, c, t, g, unknown or other
  misc_feature (121)..(121): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (346)..(346): a, c, t, g, unknown or other
  misc_feature (346)..(346): n is a, c, g, or t
tcagtcacgtactacacgaccggtgctcgatttagctctacgctcaggggggggtcacaagaggcagcgctctcgggacgtctccaccatggcctgggctctgctgctcctcactctcctnactcaggacacagggtcctgggcccagtctgccctgactcagcctgcctccatgtctgggtctccgtggacagtcgatcaaccatctcctgcactggaaatgcagtnagtggtggtacttntntaccttgtcctcctggtaaccgacaacaccaggaccaaacgacccccaaactcattacgtttacgggtactaaagtaacgccgtccctcgacgggtctttcngactcgtcttcgtctggctaccgaagtctaggaccaacgacggtccctacccgtcgaactactctcgtcgaccgtcgacgggaccgaggacgtaggtcttaggtttacttttacgttgttacgttaccagtatgacgtagggaaagttgtaacgtagtttagttcggtttacgtttagggaacggttacgggtaacccgtaagggttacccttaaccgggttccgttacgggtccgtaaccgaccccggtaaacggacccccgtaaacccctagtaccgttaccctaccgtttcccttcccggtttccccctaccccg

SEQ ID NO: 263390 - DNA, 696 bp, Homo sapiens
  misc_feature: GYAE6OF01DZ6HQ.13.73.G07.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (442)..(442): a, c, t, g, unknown or other
  misc_feature (442)..(442): n is a, c, g, or t
  modified_base (556)..(556): a, c, t, g, unknown or other
  misc_feature (556)..(556): n is a, c, g, or t
tcagtcacgtactacacgaccggtgctcgatttagctctacgctcgaggggggggtcacaagaggcagcgctctcgggacgtctccaccatggcctgggctctgctgctcctcactctcctcactcaggacacgaggtcctgggcccagtctgccctgactcgagcctgcctccattgtctggtctccgtgacagtcgatcacntctcngacatagaatgcagtgagtcggttggacttatcgtaccttcgtcgtccgtaggtaacccaacaaccaccgaacggaaccaaaccgaacccctaaacttacgtaacgtttaacgtttaaccggggtaactaaacgttaacggcccgtacccgtagtaacgggttcttttacgcgttacgttccgtacgttccgtacgtcgtaccttaccgaacggttcgtacgaaccgaaaccncccggtacctaccccgtataacctacgtttaccgccgtaacggtaccctaccggaaccgggacggtaaaccgggacgtaacggttacgttacgtttaacgttttacgtcgtttnttaccaagttgacgtgtaagagtcgtatacttgtcgttagtttaggacgtacggaaccgtaggaccctacggttcttacggactacggaacccaccgacccctaccgctcgtaacctcgttcccgttcgcccccttaccg

SEQ ID NO: 263391 - DNA, 903 bp, Homo sapiens
  misc_feature: GYAE6OF01ANM92.13.73.G07.1.454.CMB.1.raw
  modified_base (203)..(203): a, c, t, g, unknown or other
  misc_feature (203)..(203): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacgagggtcctgggcccagtctcgccctgactcagcctgcctcatgtctgggtctccgtggacagtcatcaccntctcctagcacgtaaggaaatacgctaggtgtagttcggttggggtaacttagtcgtaccgtttgttccgttccgttacggtaaccgtaacccaaaccgaacccgaacggaaccgaaaaccccgtaacccccctaaacctaccgttaacgttttaaccggtttaaccgggggtaacctaaaagtaaccggtcccggtaccccgttacggtacgggttccttttcgtaacggtcttccggtcctttcgtaccgttacggtaccttacccgtaacggtcgtaccggaccgtaaacccggtacccggtacccgtttcccctaacggtaacctaaacgtttccgtaccgttacccggtaacccgttccgggaacgggtaccgggaaccgggtacggtaacggttcgttaacggttttacgttttacgttcggttttacgttaccgtagttaaccgttggaaccggtaggggtaacggtacgtagtttaagtttacgttacgtttaccgggtttaaggggtaacggttacccggggtaaccgttaaccggttccgggttaaacccggtttcccggtttaacgggtaccccgttaacccgggaaccccggtaaccccgttaaacccccggtaaccccgttaccggttacccgtttaacccggaccccttttaccccgttcccgggtttcccccccttaaacccggg

SEQ ID NO: 263392 - DNA, 739 bp, Homo sapiens
  misc_feature: GYAE6OF01CVCA9.13.73.G07.1.454.CMB.1.raw
tcagtcacgtactacacgaccggtgctcgatttagctctacgctcaggggacccaaaaaaccacacccctccttgggagaatcccctagatcacagctcctcaccatggactggacctggagcattcctttttcttggtggcagcagcaacaggtcgcccactcccaggttcagctggtgcagtctgcagctgaggtgaagacgccgtggggcctgagtgaagatcgtcctgacctaaggtcctttcgttacggtttacctacctttagcgagtcttacttctttagtcgaggtcgttgggtcgccggaccgacgggcccccgtagggaaccggagggtaccgtcggtaggtgggaggtcgggtagtggactccgaccgtacccctaaacgaaaccggaacacgaagtactagtaggaacgaacggtaaccctacgggacgggactacgtacttaccaccgtagtacggaacgacgaaccgaaccaacaaccgtaaccgaaccgtaacaccgacgtaccctagaacgggtagggtacgggtacggagggacgtccggtagtaacggtactaacggtacggaaccggtaccgggtaccggttccggttagtttaggtttcgttagggtacggtaggtacgggtaagggttagggacgggttacgggtaggtgggttaacggtaagttacgtaaaccggtaacttaaacgttttaaccgtaaacgtttacgtttaaacggg

SEQ ID NO: 263393 - DNA, 804 bp, Homo sapiens
  misc_feature: GYAE6OF01B5ZGQ.13.73.G07.1.454.CMB.1.raw
tcagtcacgtactacacgaccggtgctcgatttagctctacgctcgaggggggggtcacaagaggcagcgctctcgggacgtctccaccatggcctgggctctgctgctcctcactctcctcactcaggacacgacgggtccgtcgggccagtctcgcccgtgacctcacgcctcgcctcctagtcgtcgtcggtcctaccgtggtacacgtactactaccacctacttcctcctacgtactaacgtaaggtaaactacgtacgtagtagttaggttagggtttacggttaacttacggttccgttaccgttttcgtcccgttaccggttaacgaaccgaaccctaaaccgacccgaacggaacccaaaaccccgtaccccttaaagtttaccgtttaaggttttaaccggttaaccggaactaaacggtccggtccggtaccctagggttaccgttctttagaccgtatccgttcgttaccgtcggtactacccgtacggttacgtcgtaaccggaacctaccggtacccgtacccttagactaccgtactcgtacttacggaccgtacggtacgggaccggacgtacgtacggttacgtttacgtttagtttcgttgttactacgtacgtggtaagaacggtaaggtacgtgttaaggttacttaggtttacgttagggtaaggttccgggacggttaacgtccggttacggtaccgttacggtacgaccggaccctaacccggaccgtaacccctagtaccgtactaccccgttaccttacgttaccccgtacccttcccg

SEQ ID NO: 263394 - DNA, 677 bp, Homo sapiens
  misc_feature: GYAE6OF01BC365.13.73.G07.1.454.CMB.1.raw
  modified_base (220)..(220): a, c, t, g, unknown or other
  misc_feature (220)..(220): n is a, c, g, or t
tcagtcacgtactacacgaccggtgctcgatttagctctacgctcaggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtggggcctcagtgaagntctctgacaaggtcttgtgttactaccttagcagtctattcttatcgaggtcgttgggtcgcgtaacgaccggtccccgtagggaaccgagggtacctcgggaggtggaggtgggactgggactcgtacgtacccgttaaacgaaaccggtaaacacgacgtaacgtagtacggaacgaacgtaacctcggaggacaaggtaccttcgacccgtagtacgaacaacgacgaacctacaagtaaccaaacgtaaacacgaacgtacctaacgagtacgggtacggaggtacggcgtacgtagaagtacgtaagtaccggaaaccggtccggtaaccggtccggtttaagttacggtttagtaaccgggtgtacgggtaagtaggtacgggtagtggtaacgagggttacgaagttaggtaccttaagttaaaaccgtttctaacgttacgttaaacgg

SEQ ID NO: 263395 - DNA, 749 bp, Homo sapiens
  misc_feature: GYAE6OF01CWGXV.13.73.G07.1.454.CMB.1.raw
  modified_base (273)..(273): a, c, t, g, unknown or other
  misc_feature (273)..(273): n is a, c, g, or t
tcagtcacgtactacacgaccggtgctcgatttagctctacgctcaggggacccaaaaaccacacccctccttgggagaatccctagatcacagctcctcaccatggactggacctggagcatccttttctggtggcagcagcaacaggtgcccactcccaggttcagctggtgcagtctgcagctggaggtgaagaagccgtggggcctcgagtgaagatctcgtgacgaaggtcttcgtaggttacctacgtttagctagtcttatcttancgacgtcgttgggtcgaccgacgtaccgggtccccgtaggaaccggacggacctacgggaggtaggagtgggagtcggactaccgaccgtacccgttaaacgaaaccggaaacacgtaacgtacgtaacggacggtaacgaaccgtaaccgtacggaacgggacctaacgtacttaacccgaaccgtagtaccggaaccgacgtaacggaacctaaccgtaacgtaaacccgaaaccgaaacccgtaaccgaaaccggtaacccgtaagtaacgggtaacgggtaacgggttacggaacgggtaccgtacgtaaggaacgtaagttacgaacgggaccgtaacggtcggtaccgttagttaacgttcggtagtcggaagggtaggtagggtacgggtcgggtacggtacgtaagggttacgtaaagttaccggtaaacgtaaacttaaagtttacccgttaattaaggttaaccgg

SEQ ID NO: 263396 - DNA, 682 bp, Homo sapiens
  misc_feature: GYAE6OF01DH2LA.13.73.G07.1.454.CMB.1.raw
  modified_base (639)..(639): a, c, t, g, unknown or other
  misc_feature (639)..(639): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacgagggtcctgggcccagtctgccctgactcagcctgcctcatgtctgggtctcctggacagtcgatccaccatctcctgctaacgtaggaaatgcagtgagttggttacggtactatcgtaccgttgtctaccgtacggtaaccgacaacaccgacggaacaaaccgaccccctaaagtctaacgtttaagtttaccggggtactaaagtaacggccgtacccgtcgtacggttctttacacgtatccgtcttcgtcgtcggaccttacgaacgtcgtacggacctaaccgccgtccctaccgtagaacttaactcctacgacgtacctaccgacggacggtacgacgacgtacttgttacgtttttatggtttacttacatacgtgtacggaaggacggtagttagtacgtttagttacgttgttacggacggttacggaacgtacggttcctacccggttccgttaggacccgaaggtacccggaaaccgtaccccgtaaacccncgttaccgtaccctagttaacccttcccggttcctaacccccg

SEQ ID NO: 263397 - DNA, 750 bp, Homo sapiens
  misc_feature: GYAE6OF01AIXX4.13.73.G07.1.454.CMB.1.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
tcagtcacgtactacacgaccggtgctcgatttagctctacgctcaggggacccaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagaagccgtggggcctcgagtgaagntctctgcaaggtcttcgtcggttactaccgtttagcagcttatcttatcagtcgtgggngcgacgcggtccccgtggacggacggacgtcggaggtggaggtgggagtggactacgtaccgtaccccgttaaacggaaaccggaaaccacgaagtaacgtaagacggaaccaacgaacccgtacgacgggtacacgtacttaccaacgtagtacggaaccgaacgaacgaaccaaccgtaacgtaaccgaaaccgtaaaccgaaccgaaccggtacccttaacgaacggtacggggtaacgggtacgggtaacgggtaacgtacccggtaggaaacgttaacgttaacggtaacggaacccgggtaaccggtacccgggttaccggttaggtttaacgtttaggttacggtagggaccgggtaagggtagggttaggggtaggttacgggtacggtaagggtaggtaaacgttaacgtaaaccgtaaacgttaaagtttaaccctttaaacgttaagtttaaccggg

SEQ ID NO: 263398 - DNA, 781 bp, Homo sapiens
  misc_feature: GYAE6OF01C1YEA.13.73.G07.1.454.CMB.1.raw
  modified_base (480)..(480): a, c, t, g, unknown or other
  misc_feature (480)..(480): n is a, c, g, or t
tcagtcacgtactacacgaccggtgctcgatttagctctacgctcgaggggggggtcacaagaggcagcgctctcgggacgtctccaccatggcctgggctctgctgcctcctcactctcctcactcaggacacgcgggtcctgggcccagtctgccctagactcacgcctcgcctccagtgtcgtgggtcctaccgtggactaggtcctaatcccaaccttattccctccgtacgctaaccgtaaggaaatacgcgtaggtggaagttcggtttacgggtactttacgacgtaaccgtttcggtccttccgtaggtaacccggaaccaaaccgacccgaagacccgaaacgaccccctaaattcgtaacttaacgggtttacggaactaaacgtaacggccgtacctcgtaaggttccttagtgaaccgtctcgttacctcgtacgcttacaacgtgtacgactacaccgtctccgtanacgtactcgtacgaccgtacacccggtaagcccgtacgggaacgttacggtcgttaacgttttaactttttcgtggttacgtttaccaattaggtgaaccggtagggaacgttacgtagttaacgtttacgttacggttaggtttacgggtaaggtaccggggtaaacctaacggtacccggttacccgttacggttcgggaaaccgtacccccgacggtaaccccccggtaaccgtaaacccccgttggtacccggtttactacccgggtttaccctttcccggaccccctttaaccccg

SEQ ID NO: 263399 - DNA, 645 bp, Homo sapiens
  misc_feature: GYAE6OF01ETJPJ.13.73.G07.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
tcagtcacgtactacacgaccggtgctcgatttagctctacgctcaggggggggtcacaagaggcagcgctctcgggacgtctccaccatggcctgggctctgcctcctcctcagccctcctcactcagggcacaggatccgtgggctcagtctgccctgactcagcctcgctcgagtcgtccgggtctctggacngtcagtcaccatctcngcacgtggaaccngctagtgacttggttaggtgttaactaactatcgtctccgtacggtaccaacaaccaccaggaccaaacgaccccaaatccatacgtatttancgtatcgtacagtacgccgtcctcgacgggtccngactccgtcttccacgtctcctacgtacgtctcgaccacgaccgtccctaccgtcgtacctacgtccgtcgtcggtactccggagtccgtaggtaacggcgttagacgttcgtacggtttactttacgttaacgtcgtaccgttcgtaccttacgtacgttaccgtgtaccgggtacgacgtacgtaacccgttagtacccgtttagttaaaccgttccgggttaccgggacgggacggtaccacggtacgtacccggtaccgttcgtacggcccgtacggtccgtacccggg

SEQ ID NO: 263400 - DNA, 700 bp, Homo sapiens
  misc_feature: GYAE6OF01C32EI.13.73.G07.1.454.CMB.1.raw
  modified_base (163)..(163): a, c, t, g, unknown or other
  misc_feature (163)..(163): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (439)..(439): a, c, t, g, unknown or other
  misc_feature (439)..(439): n is a, c, g, or t
  modified_base (649)..(649): a, c, t, g, unknown or other
  misc_feature (649)..(649): n is a, c, g, or t
  modified_base (659)..(659): a, c, t, g, unknown or other
  misc_feature (659)..(659): n is a, c, g, or t
tcagtcacgtactacacgaccggtgctcgatttagctctacgctcgagggaacccaaaaaccacacccctctgggagaactccctagatcacagctcctcaccagtggactggacctggacgcaaacttcctttttgttggaggcagccagacaacgtggtcncccactcccgtagtcagctaggcatgtcctgctagcgtagagtacgaaagacgtcggtcgggccngtaagcgaagtctccncgtagaacgtacgtcttcgtaggtaactacgttancgatactagtagtanacgngngtacgggnacgaacgtcggaccnggagtacgactggagtggagtaggnttaggcttacgaccaacgtaacaaacggactagaaagttcaaagggtacaaacgtcggaacccaggaggttcaaacttcggtacaacgtanacggaaacaacaagaactaacgaactaacaaacgtaaccgactaacggaaacctacggttaaggacgggttaagacgggtaaactaccgggtacttaaaggaagttacggtaagtaaccccgggggaaaccctaaacggggttactaaccggttaaaggtttccgtagttacgggtaaccggtaagacgggttagacgggttaagacggnttaaacgggnttaagaaccggtataaaagttactaacgaattacgtaaacg

SEQ ID NO: 263401 - DNA, 763 bp, Homo sapiens
  misc_feature: GYAE6OF01D18JK.13.73.G07.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacgagggtcctgggcccagtctcgccctgactcagcctgcctcatgtctgggtctccgtggacngtcgatcaccntctcctgcacgtaggaaatgctagtgattgggttcggtactttagtgtacctttcgtccgtccttcggtaacccgaaccaaccaccgacggaccaaaccgccccctaaatctaagttacggtttacgggtacaagtacgccggtcctgtacggttcttcgtgtacttccgtctttctcgtcgtacctacccgtaaggtctacggacctaaccggtacccggtcccttacccgtaacggtaacctacggtttccctacggtccggtaaccgtccccgaggggaccggtacgggtaaccggacggttcgtttacgtttaacgtttttacgttcggtttagttactacggttagtcggagtaaacggggttacgtagggtttaccttaaggttttcgttcgggttttaacggtttacgggaacgggttcggaaacccgggttaaggtcccggttaccccgtttgggttccggtaacccgacggtaacccgacccgggttaacccccaaaccgttccgttccgaccctttaccgttcccgttcccccgttccccgttccccg

SEQ ID NO: 263402 - DNA, 968 bp, Homo sapiens
  misc_feature: GYAE6OF01C69C3.13.73.G07.1.454.CMB.1.raw
tcagtcacgtactacacgaccggtgctcgatttagctctacgctcagggggggggtcacaagaggcagcgctctcgggacgtctccaccatggcctgggctctgctgctcctcactctcctcactcaggacacgaggggtcctgggcccagtcctcgccctgactcacgcctcgccctccagttgtcgtggggtccttccgtagggactaggtctactccacctatcctccgtcgtactaacgtaggtaaatacggactaggtgtagttgggttcgggtacttagtacgtccttcggttcctccgtacggtaacccgaacctaaccgaacccgaacggaaccaaacccggtaccccctaaaacttaccgttaacgttttaacggtttaacccggggtactaaacggtaaccggtccggtacccgttacggtaccgggtttcctttactacggtaacttccggttctttaccgtcgtacggtaccgtaaccgtacgttcggtacggaccaaccgtacccggtccctaccgtacgtaactaacgttcttacggtcgttacccgtaccggacggtcgttacgggacggtaacggtacggttacgtcggttaccgttaacgtttaccgtcggtccgttacggtacttaccgtagtttaacggttaccggttaccggtttaccgggtttttcccggttacgggttttcggggttttcccggggtttaccccggggtttacggggggttaaccccgggggtttaaaccggggttaaacccggttaaaccgggggttttaccccgggttaacccccggggttttaaacccgggttaaccgggggtttaaccccccggtaaacccggggttaaaccccgggttaaccccgggttccccggttaccccccgggttccccccggttacccggtttacccgttaaccccggttttcccccggttttaaacccccccggg

SEQ ID NO: 263403 - DNA, 792 bp, Homo sapiens
  misc_feature: GYAE6OF01EMUJ2.13.73.G07.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagtcacgtactacacgaccggtgctcgatttagctctacgctcgaggggggggtcacaagaggcagcgctctcgggacgtctccacatggcctgggctctgctgctcctcactctcctcactcaggacacgacggtcctcgggccagtcctcgcctgactcacgtcctcgtcctccgtgtcgtcggtctcgtcgacacgtcgactcactactctcngcacgtagaacncgacagtcgtagtcgttaggtaacttacgagtacttcgtccttacgtacggaacctaaccgaccgtaccgaacggtaccaaccgacccgaagtacgtactaacgttacgttaggtttacgggacgggtactaacggtcggccgggtactacggtacggttacttaccgcgttcgtaccttcgtcgtcggtaccctagtaacggtcgacgaccgtaacgtcccgtccttaccgaacgtactaacgttccgtcgtcggtaccctaaccgtaggggacccggttaggaaccgggtagtaccggtccgtacgttacgttaaaccgttgtaacctcgtactacccgtcgttaattaccgtcggggtttacctttacgttcgttttaccgggtaggggttcccgtttaccgggtggggtaaacccggttaacgggtttaccgaaaaccggttccgggtttaaacccggttaccgggtaacgtttaccccgggaacccgttaacggtaacccggttccccgggttaaccccctccgggtttacccggtaaccgtcccgggtttaacccc

SEQ ID NO: 263404 - DNA, 456 bp, Homo sapiens
  misc_feature: GYAE6OF02FHSHJ.13.73.G07.1.454.CMB.1.raw
  modified_base (321)..(321): a, c, t, g, unknown or other
  misc_feature (321)..(321): n is a, c, g, or t
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
  modified_base (448)..(456): a, c, t, g, unknown or other
  misc_feature (448)..(456): n is a, c, g, or t
tcagtcacgtactacacgaccggtgctcgattagctctacgctcagggtcctgggcccagtctgccctgactcagcctgcctccgtgtctgggtctcctggacagtcgatcaccatctcctgcactggaaacagcagtgatgttgggacttatgaccttgtctcctggtaccgacaacacccaggcaaagcccccaaactcattattacggggtcaataagcggccctcagggctttctgatcgcttctctggctccaagtctggcaacacggcctccctgacaatctctgactccaggccagacgagctgtatttttacngttgttcatatgcaggagatgattatgtctttggagtggaccaggtcacgtctgcagccagccaacccntgcactctgtcccgccttcctctagtacgtgactgagcgggctggcaaggcncatagnnnnnnnnn

SEQ ID NO: 263405 - DNA, 489 bp, Homo sapiens
  misc_feature: GYAE6OF02HV4QM.13.73.G07.1.454.CMB.1.raw
  modified_base (476)..(489): a, c, t, g, unknown or other
  misc_feature (476)..(489): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgctaggtttcttctgtggtcttcgggcggagggtccaaagtcgaccgtcctaggtcagcccaaggctcgcccctggtcactctcgttccccgcccttcctctacgtacgtgactgagcgggctgggcaaggcgcatagnnnnnnnnnnnnnn

SEQ ID NO: 263406 - DNA, 518 bp, Homo sapiens
  misc_feature: GYAE6OF02HIAQK.13.73.G07.1.454.CMB.1.raw
  modified_base (410)..(410): a, c, t, g, unknown or other
  misc_feature (410)..(410): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaatcattatttacggggtcaataagcggccctcagggctttctgatcgcttctctggctccaagtctggcaacacgcctccctgacatctctggactccaggccgaggacgaggctgtatttttacngtttgttcatatgcagggaagtgtagtattatgttcttggaagtggactagtcaccgtcttggtcacgccaacggccaacccgctcgtccactctcgttccctacccg

SEQ ID NO: 263407 - DNA, 524 bp, Homo sapiens
  misc_feature: GYAE6OF02GRSC5.13.73.G07.1.454.CMB.1.raw
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacaccccaggcaaagcccccaaactcattatttacgggtcaataagcggccctcagggctttctgatcgcttctctggctccaagtctggcaacacggcctcctgacaatctctggactccaggccgaggacgaggctgtatttttacngttgttcatatgcagggagngtgattatgttctttggaagtggacctaggtcaccgtcttggtcacgtcccaaggacccaacccgactcgtaccactctcgttcccctaccc

SEQ ID NO: 263408 - DNA, 534 bp, Homo sapiens
  misc_feature: GYAE6OF02HD19H.13.73.G07.1.454.CMB.1.raw
  modified_base (263)..(263): a, c, t, g, unknown or other
  misc_feature (263)..(263): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccganaacacccaggcaaagcccccaaactcattatttacggggcaataagcggccctcagggctttctgatcgcttctctggctccaagtctggcaacacggcctcctgacatctctggactcgaggccgaggacaggctgcctattacngctgctcatangctaggtttcttctggttcgtcgttcgggcggtacgggtccaaggtcgaccgtcgtacggtcacgtcccgaaggcctccggtccccctggtcccacgttcctccgttacccccg

SEQ ID NO: 263409 - DNA, 524 bp, Homo sapiens
  misc_feature: GYAE6OF02GKRSR.13.73.G07.1.454.CMB.1.raw
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattagtttacgggtcaataagcggccctcagggctttcngatcgcttctctggctcaagtctggcaacacggcctccctagacaactctctggtcctccaggctgaggacgaggctgcctattacngctgctcatangctaggttcttcgtgttcggtcttcggcggtagggtaccaagtcgacccgtcacggttcacgccaaggtctccgccccctggtcctactcgttcccg

SEQ ID NO: 263410 - DNA, 526 bp, Homo sapiens
  misc_feature: GYAE6OF02IETWA.13.73.G07.1.454.CMB.1.raw
  modified_base (323)..(323): a, c, t, g, unknown or other
  misc_feature (323)..(323): n is a, c, g, or t
  modified_base (466)..(466): a, c, t, g, unknown or other
  misc_feature (466)..(466): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttanaacggaacacagactatggacagacctcgaggcagattcaccatgacgacagacacataccaacgacaacacgacctacatcggaaggtgagggacgcgtagacgatagtaggaacgacgacggccgttagttattaagttgngacgagaggtggaggtggcgaggtggattagacgaacgtaatttaactacttaattaacg

SEQ ID NO: 263411 - DNA, 610 bp, Homo sapiens
  misc_feature: GYAE6OF02H8CQ1.13.73.G07.1.454.CMB.1.raw
  modified_base (567)..(567): a, c, t, g, unknown or other
  misc_feature (567)..(567): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctctgcactaggaaatagcagtgatgttgggacttatgtaccttgtctccgtggtaccgacaaccacccaggtaacgaccccaaactctagttagtttacggggtacaagtaacgccgtacctcgtacggtcgtttctgtacgtcgtcttctcgtcgtcctacctacgtcgtcggacacgaccggccctacctacgactactctcgtacgtacgtacgacggacgacggacgaggtacgtgttacttttagttgttagttctatagtgagaggaaggtagtagttattgtagttgttaggtagtacggacgtacgtaccgtaccgtcgttcggtacgacgtaccgaaccgtacccgtaacccnccgtacgtaccgtaccttcccgttcgttccccctaccttcccg

SEQ ID NO: 263412 - DNA, 540 bp, Homo sapiens
  misc_feature: GYAE6OF02H6A43.13.73.G07.1.454.CMB.1.raw
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcagggcacaggatcctgggctcagtctgccctgactcagcctcgctcagtgtccgggtctcctggacagtcagtcaccatctcctgcactggaaccagcagtgatgttggtgttataactatgtctctggtaccaacaacacccaggcaaacgccccaaaatcatgattatnatgtcagtaagcgccctcgagggtccctgactcgctttcnctcgcctcaagtctgcacacgctccctgaccatctcgtcggctccgagctgaggtangtacgtgtagtatttactatcgtntcgtctctatgtcgacgcggacacgtactacgtacgttacgttacgtcggttaccggacgggaaccggtaaccgaacgtcgtaccggtacccgttaccggtacggtacccgacggtaaccccgg

SEQ ID NO: 263413 - DNA, 641 bp, Homo sapiens
  misc_feature: GYAE6OF02H40I5.13.73.G07.1.454.CMB.1.raw
tcagtcacgtactacacgaccggtgctcgatttagctctacgctcaggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttcgtggttacacctttagcagctatcttatcagctgggtagcgacacggcccctggacgaggactcggaggtggatgggatgggatcacgcccttacgaaacggaaacacgaagactagtacggaactaagaaccctcgagggacagtaactttccaaccagtacggaaccgaacaacggaacacaactaaccgaacgaaacaaccgaacgtaccctaacaacgttaggggaggttaggaacggacgtaccgtaggaacgaagtacgtacggaaccgacgaaccgggtaccgttagttaacgtttagttaggttaggaccggtaggtacggtggggtaaggttgggacgtaaggttcgggaattacggtacgtaaacttaaacgttttaacttacgttatttaacgg

SEQ ID NO: 263414 - DNA, 514 bp, Homo sapiens
  misc_feature: GYAE6OF02G1WL0.13.73.G07.1.454.CMB.1.raw
  modified_base (495)..(495): a, c, t, g, unknown or other
  misc_feature (495)..(495): n is a, c, g, or t
  modified_base (499)..(514): a, c, t, g, unknown or other
  misc_feature (499)..(514): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccaaactcataatttttactgtcagtcatcggccctcaggggtttctaatcgtttctctggctccaagtctggcaacacggcctccctgaccatctctgggctccaggctgaagacgaggctgattattactgcagctcatatgcaggtttcttcgtgttggtcttcgggcggagggtcaaagtcgaccgtctaggtcacgccaaggctcgcccctcggtcactctccgtccccaccctccttctacgtacgtcgaccgtggacggcgggtctcgggaccgaagggtccgacgtagtagcngcgnnnnnnnnnnnnnnnn

SEQ ID NO: 263415 - DNA, 586 bp, Homo sapiens
  misc_feature: GYAE6OF02GA3IR.13.73.G07.1.454.CMB.1.raw
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacaccgtttagcagctatcttatcagtcgttgggtgcgacgacggcccctaggacgaggactcggagtgggagtggggatggactcgacgtcccgttaaccgaaacggaaacacagaactagtaggaacacgaacctccgaaggcaagtactacaccgatacgacgacagacacataccacgaacacacgccctaanagttggaggtagaggacncgtagganatagtagaaccgtacgaccggtcgtagttacgttagtgtaggagtaggaggtcgggtaaggtacggacgtaaggtacggtaatacgttacggaaactaaactttacgtttaactattaaccg

SEQ ID NO: 263416 - DNA, 508 bp, Homo sapiens
  misc_feature: GYAE6OF02FVYZB.13.73.G07.1.454.CMB.1.raw
  modified_base (428)..(428): a, c, t, g, unknown or other
  misc_feature (428)..(428): n is a, c, g, or t
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggccccccagacgtcatccatttagtgggggcaagtaggcggccgtcgagggatttccactcgcttctctggctccagtctggcaacacggcctcctgacatctctggtctccaggctgaggacgaggctgtcctattactgctgctcatntgctagttcttctgtgtcgttgcgtaggtctaagtcgccgtcgtacggtcagccgacgctccgcccctcggtctactccg

SEQ ID NO: 263417 - DNA, 511 bp, Homo sapiens
  misc_feature: GYAE6OF02IE36A.13.73.G07.1.454.CMB.1.raw
  modified_base (421)..(421): a, c, t, g, unknown or other
  misc_feature (421)..(421): n is a, c, g, or t
  modified_base (497)..(499): a, c, t, g, unknown or other
  misc_feature (497)..(499): n is a, c, g, or t
  modified_base (501)..(511): a, c, t, g, unknown or other
  misc_feature (501)..(511): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgcttgctcatatgcgtaggtttctttcgtgttcggtcttcgggcgggtacgggtaccaaagtcggacccgtccgtaaggtccagacccaaggtcncgccccctggtcaccttctcgttcccacccttcgtctacgttacgtcgactgacgtcggctcggcaggcgacatgnnnannnnnnnnnnn

SEQ ID NO: 263418 - DNA, 583 bp, Homo sapiens
  misc_feature: GYAE6OF02GE5VD.13.73.G07.1.454.CMB.1.raw
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatggttgggacttatgaccttgtctcctggtaccgacaacacccaggcaaacgcccccaaactcattagttacgggtcaataagcggccctcgagggtctttctgatcgcttctcgtggctccaagtctggcaacncggcctccctgacaactctctggacctccgaggccgaggacgaggctgtattttactgtttgtcatntgcaggaagtagtgatttagtgttacgtttaggaacggttacgggaacctaagggtcctaccggttccgttgggtaccgaacggaccccgtaaacgggtccccaaaccccgtcttacggtacctaccttccgttccgttaccccctacccccg

SEQ ID NO: 263419 - DNA, 611 bp, Homo sapiens
  misc_feature: GYAE6OF02HOGZA.13.73.G07.1.454.CMB.1.raw
  modified_base (461)..(461): a, c, t, g, unknown or other
  misc_feature (461)..(461): n is a, c, g, or t
tcagtcacgtactacacgaccggtgctcgatttagctctacgctcaggggacccaaaaaccaacacccctccttgggagaatcccctagatcacagctcctcaccatggactggacctggagcattccttttcttggtggcagcagcaacaggtgcccacctcccaggttcagctggtgcagtctgcagctgaggtgaagaagccgtggggcctcagtgaagatctcctgcaaggtcttctggttacacctttagcagcctatcttatcagctgggtgcgacgcggcccgtgggacgtaggactcgaggtgagtgggatggactgacgtcccttaacgaacggaaaaccactaagacctatacggaacacgaacctcggacggacgagtaattccgaaactacgtagaaccgaacgaacgactaacaacgttaacaacgaacaaccaagtcctaaacacgnggaaggtaggaaggacaccgtgaacgtatacgtagacgaacgaccggtcgttacgttagtttaaatggtagtacgaggtacggtgggaacggttgggactaagggttacgattacgtacggaaattaaactttacgttaactattaaacg

SEQ ID NO: 263420 - DNA, 633 bp, Homo sapiens
  misc_feature: GYAE6OF02HKK0F.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaaccacccaggaccaaacgaccccccaaaactccaattaacgttttaccggggtacaaagttaacgccggtccctcgagggtcctttcgtagatccgcttctcgtcggctaccaacgttctacggaccaacgacggcccttcccgtacgaacctaattctctcggtacctccgacgggccgaggaccgaggtcttggttaactttttacgtggtttagttctaagttagtgacgtaagggaaggtagtagtaagttagttgttcgtttagggaaggtcgggaacgtaacggtacctaccggtccgttggtacacgcccgtaaacggccccaacccgcttacgtacctaccgttctccggttcccctcccg

SEQ ID NO: 263421 - DNA, 542 bp, Homo sapiens
  misc_feature: GYAE6OF02IY32F.13.73.G07.1.454.CMB.1.raw
  modified_base (418)..(418): a, c, t, g, unknown or other
  misc_feature (418)..(418): n is a, c, g, or t
tcagtcacgtactacacgaccggtgctcgatttagctctacgctcaggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgaggtggatgggatggatcagcccttacaacggaaacacgacgactataggacaagaacctccgagggacagacttaccaaccagtacgacgacacgacacaatacaacaacacagcctanagtaggaggtagaggagccgtaggagatagtagacgacgaccggtcgtagttacttagtagtgacgtagaggtggaagggtgcggtagtaggtatagtacgaataacttacgtacttattaacg

SEQ ID NO: 263422 - DNA, 656 bp, Homo sapiens
  misc_feature: GYAE6OF02I5ZWC.13.73.G07.1.454.CMB.1.raw
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgagtgaagaagcctggggcctcagtgaagatctcctgcaaggcttctggttacacctttagcagctatcttatcagctggtgcganagcccctggacgagactcgngtggatgggatggatcgagacccttanaacggaaacacagactataggacagaaacctcgaggcagtacttcaaccatcggaacacacgaacacactaacgaacaaacgaaccaacgaccctaacgaacgtacgggtaagggtacgaagggtacgtacccggtagaacggaagttaacgttaggaaccggtaaccggaaccgggtacccggttaagtttaacgttaaagtttacggtagtaccggtagggtagttacggggggggggggtaattacggggtacgtaacggggtacgggttaactttaacggtaaccggttaaacgtaaaacttttaacgtttaacgttaagtttaaacccgg

SEQ ID NO: 263423 - DNA, 665 bp, Homo sapiens
  misc_feature: GYAE6OF02HB2IL.13.73.G07.1.454.CMB.1.raw
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatggacttgtctcctggtaccgacaacacccaggcaaacgccccaaactcattatttacggggtcaataacgcgccctcgagggtctttctgatcgcttctcgtggccttcaagtctggacaaccgacggccctccctgacaactctcgtacggtcctaccgacggtaccgaggaccgaggcttacggttactttttacgtggtttacgtttactattattcgaccgtaagggaaggtagttaggtaagtttacgttaggttcggttttagggtaaagggtacgggtaaccgttaacgggtaccgtaacccggtttccgtttacggggttaacctaccgggaccccgtaacgggtaccccgtaaacccccgtacgtttaccgtacgtaccccgttaccgtttaccgttacccccgttaaccccccg

SEQ ID NO: 263424 - DNA, 628 bp, Homo sapiens
  misc_feature: GYAE6OF02IYVYE.13.73.G07.1.454.CMB.1.raw
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcaccatctcctgcactaggaatgcagtgattggttaggtacttatgtaccttgtcctcctacggtaacccgacaaccaccccgaggaccaaaccgaccccaaactctaagtttacgtttacggggtactaaagtacggccggaccctcgagggttctttcgtgagtccgtcttcctcgtggcctacgaagtcgtcggacaaccgccgtccctaccctagactactctacgtcgactccgagccggaggaccgngtctgttacgttttactgttattcattntgagtaggagtaagttatagtttagtcgtttaggttagggtaacggtcggaacgtacgttacgtaccgtttcgttcggtaaccgacgtacccggtaacgacccctacccgtacttccgttacacccgtaccgtttaccgtccccctaccc

SEQ ID NO: 263425 - DNA, 792 bp, Homo sapiens
  misc_feature: GYAE6OF02GPM5J.13.73.G07.1.454.CMB.1.raw
  modified_base (614)..(614): a, c, t, g, unknown or other
  misc_feature (614)..(614): n is a, c, g, or t
  modified_base (640)..(640): a, c, t, g, unknown or other
  misc_feature (640)..(640): n is a, c, g, or t
tcagtcacgtactacacgaccggtgctcgatttagctctacgctcaggggggggtcacaagaggcagcgctctcgggacgtctccaccatggcctgggctctgctcctcctcagcctcctcactcagggcacagggactcgtggctgacgtcgtcgcctagtactcgacgtcctcgctacgtagtcggtccggtctccgtacggacctagtcgacgtaccaacctatcctccgtcgacctacgtaccggaacctacgtacgtaggtacgtagttgggtttacgggttacgttaaactaaacgttagttcggttcccttccggtaaccggttaaacccaaaaccgtaaccccgaacccggtaacggaacctaaaaccccggaaaccccctaaaagtccctagttagttaacttttacgtagtacgtttacggtacgtaaggttaaccgggccccgtacccgttaccgggtaccggggttcccttaggaaccttcccggtacttacctcgtacgtccccttaacgtaacggttcgtacgaaccctaaccggtacccggtccctacccgtaagaccctacgttccgtcggtacgtcctacgacggttcacgggtatntacggttgtctacgtacttacttcgntcgtgacctatactgtacgacgtacgacgtacgtctaaccgtagttccgtaacggttacgggtaccgggacggtaaccggtacctaaacggtccggttaacccggtaacccgtaccggttaccgtaccggtacccgtaacccggtaacccgg

SEQ ID NO: 263426 - DNA, 737 bp, Homo sapiens
  misc_feature: GYAE6OF02FQ5HI.13.73.G07.1.454.CMB.1.raw
tcagtcacgtactacacgaccggtgctcgatttagctctacgctcaggggggggtcgacaagaggcagcgctctcgggacgtctccaccatggcctgggctctgctgctcctcactctcctcactcaggacacgagggtcctgggcccaggtcctgccctgacctcagcctgcctccatgtctgggtctccgtggacagtcgatcaccatcctcctgcacgtggaaatgcagttgtagttggttgggactttatcgtaccttgttcctacctacggtacccgaacaaccgacccgaacggtacaaccgtaccccaaactcagtttaacgttaccgggtacaacgtaacggccggtacccttcgacgggtccttttcgtagtacgttccgtcttcgtccgtcggtacctaccgtaacgtccgtacggaccaaccgtaccggtacccttacccgtacgaaccgtacgtccgtaccgtcggtaacctcggaaccgggaccggtaacgggaccggtacggtaccgttacggtttaacgttttttaccgtgtttacgtcttaagttagtcggtaacggtagggtaagtacggtagttagtttacgttggttacggttaggtaacgggtacggtaaccgtacgggttaccgtaccggttccgttacggtccgtaaccgacccggtaacgccccgtaacccgtcctacggttcccaaccgttcccttacccgtcccgttacccc

SEQ ID NO: 263427 - DNA, 677 bp, Homo sapiens
  misc_feature: GYAE6OF02GPWWU.13.73.G07.1.454.CMB.1.raw
  modified_base (277)..(277): a, c, t, g, unknown or other
  misc_feature (277)..(277): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttctggtggcagcagcaacaggtgcccactcccaggttcagctggtgcagtctgcagctggaggtgaagaagccgtggggcctcagtgaagatctcctgcaaggcttcgtggttacaccgttagcagtctatcttatcgagtcgtggtncgacacggcccgtaggaccgaggactcggagtggagtcgggatgggactcgtacgtacccgttaacgaacggtaaaccacgtacgtaactagtacggaaccaagaacccgtcgaacgggcaaggtaactccaacgtagtacgaaccgaactacgaacctaacgaactaacgaaccgaaacaccgaaacgaccgtaacgtaggtacgggtaacggtaggaaacggtcgaaccgtaggaacgtagtaacgtacggaacgtaaccgaccggttcggtaacttacgttagttacgtacggacggtaggtacgggttaggtcgggttaggaccggtaagttagggtaacttaacggttacggtaaacccgttaagtttaaccgttaacgtacggtttaaacccgg

SEQ ID NO: 263428 - DNA, 725 bp, Homo sapiens
  misc_feature: GYAE6OF02HXTT9.13.73.G07.1.454.CMB.1.raw
  modified_base (280)..(280): a, c, t, g, unknown or other
  misc_feature (280)..(280): n is a, c, g, or t
  modified_base (361)..(361): a, c, t, g, unknown or other
  misc_feature (361)..(361): n is a, c, g, or t
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctctgcactaggaaatagcagtgagttggtagggtacttagtcgtacctttgtcctccgtggtaacccccccganaaccacccgaggaccaaaccgccccctaaaatctaattacggtttacgggacaagtacggccgccctgtacggtcctttgngtactcgtcttctcgtcggtacctacgaagtcgtcggacctaaccgaccgtcccctaccgtagaacctacgtccttacgtacggaccctaccggacgggaccggaaggaccggacggtctagtttaacttttttacgtaggtttcttactaagttacgtacgacggtaaggggtaacgttgttagttaagtttaggtacgtttacggtttaaggggtaacgtacgggtaaaccgttaacggttcccggtaccgtttccggttaaggggcccttaaccggaacccggtaaaccggtaccccctaaccccgttacgtaccgtaaccgtaccccgtttacccgttcccgttaccccccttaacccgg

SEQ ID NO: 263429 - DNA, 699 bp, Homo sapiens
  misc_feature: GYAE6OF02HLXWM.13.73.G07.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (565)..(565): a, c, t, g, unknown or other
  misc_feature (565)..(565): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctcatgtctgggtctctggacngtcgatcaccntctcctgcacgtaggaaatgcagtgatggttcggacttatcgtaccgttgtctccgtcggtaaccgactaaccacccgacggaccaaaccgaccccctaaactactaacgtttacgtttaccggggtacaagtacggccggtaccctacgtacggtctttactcgtactccgtcttctcgtcggtcctaccgtaagtccgttacggaccaacgtcccggtacccttcccgtacggacctacgttccgttccggtacgggtccttacccgacgggtcctaacggaaacggtacggtacggtacgtagtaatttacgtacgtcggacgttcctcgtaggtacgtacttaccgtccttaaccgtttntacggttccgttacggtcgttacgtccgtaacgtccggttccgtaccgttccgtacgggtacctaccggaacccgtaccggacccctaacccgtcgttacccgtacctaccgttcccgttacccgttacccccg

SEQ ID NO: 263430 - DNA, 705 bp, Homo sapiens
  misc_feature: GYAE6OF02JBDPT.13.73.G07.1.454.CMB.1.raw
  modified_base (204)..(204): a, c, t, g, unknown or other
  misc_feature (204)..(204): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtcctgccctgactcagcctgcctccatgtcctgggtctcctggacagtcgatcaccntctcctgcactggaaatgcagtgatggttggacttatgaccttgtctcgtggtaccacacaccgacgacaacgaccccaaactctacgttacgttacgggactaagtaacgccgaccgtcgaggtcttctgtactcgtcttctcgtcgtactacgaagttccgtacggacctaaaccggtaccgtcccttacccgtacgtaacctaacgttccgtaccgtacggtaccccgttaccgaaccgggacccggtaagggaccgtaacggtcgttacgttagtttttaaccgtgtttacgttacctagttacgtcgtaagtacgggtaaggtaggtagtacgtttagttacggttacgtttagggaaacgttaccgggtaacgttaaccgggttaccttacccggttacggttaacggtccggtaaccggtacccgaacccgttaacccgtaaccccgtacgttacgtcccgttaacgtcccgttaccgttacccccgttacccg

SEQ ID NO: 263431 - DNA, 523 bp, Homo sapiens
  misc_feature: GYAE6OF02HCOWK.13.73.G07.1.454.CMB.1.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataattatgatttcactaatcggccctnaggtgtatctaatcgcttcactggctccaagtctggcaacncgcctccctgaccatctctgggcctccaggcaggaggacgaggctgatttattacgngcggctccgnggacgtattacgcctacctttancgttccttcgggactgtacaccgaggtccaccggtctaggtcacgtcccaaggcccaacccntcgtccactcctccg

SEQ ID NO: 263432 - DNA, 607 bp, Homo sapiens
  misc_feature: GYAE6OF02G6N6O.13.73.G07.1.454.CMB.1.raw
  modified_base (212)..(212): a, c, t, g, unknown or other
  misc_feature (212)..(212): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (345)..(345): a, c, t, g, unknown or other
  misc_feature (345)..(345): n is a, c, g, or t
  modified_base (585)..(585): a, c, t, g, unknown or other
  misc_feature (585)..(585): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(599): a, c, t, g, unknown or other
  misc_feature (598)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaagcccccaaactcataattttacngtcagtcatccggccctcgtaggggtttctaattcgtttctctggctccaagtctggcaacncggcctccngaccatctctgggctccgaggctagaagacgaggctgtatttattactgactagctcatagngacgtagtttctctggttcggttcgttcgggcggtaagggtacctaaaggtcggtaacccgtccgtaggtaccaccggtacccgaacgggtccgtcccggtcccccgtcgggttaccctaccgttccgttcccgttaccccctaccccgttcccttaccgttacgttaccggtcgtacgttcggaccgggtccggcgtacgggaccgaacgggccgtacgacgtacgagcgtagcgtgcngtacgcncngngnncncncnng

SEQ ID NO: 263433 - DNA, 651 bp, Homo sapiens
  misc_feature: GYAE6OF02IS9G3.13.73.G07.1.454.CMB.1.raw
  modified_base (347)..(347): a, c, t, g, unknown or other
  misc_feature (347)..(347): n is a, c, g, or t
  modified_base (396)..(396): a, c, t, g, unknown or other
  misc_feature (396)..(396): n is a, c, g, or t
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatcctcctgcacgtagaaatgctagtgatggtggtacttatgtaccttgtctcgtggtaccgacaaccacccagacaaaccgcccctaaactctagttacgtttacgggtacaagtaacgccggtcctacgagggtctttacgngtactcgtcttctcgtgacctcgtacgtctcgacacgtacgtccctacngaactatcgtcgtacgtacctacgcggaccggaggacgacgtcgttagttacgttttcgttgttacgttactagttactcgtacggtaagggtaaggtgtagttagttagttcggttacgttagggtaacggtacggtaaccgtaggttcccgtacgggttccgtaccgggtcgtaaccggacccggtaaccggtaccccgaaccccgttacgtcgtaacccgtccggttaccttaccccggttaccccctcccg

SEQ ID NO: 263434 - DNA, 580 bp, Homo sapiens
  misc_feature: GYAE6OF02FRJ8M.13.73.G07.1.454.CMB.1.raw
  modified_base (438)..(438): a, c, t, g, unknown or other
  misc_feature (438)..(438): n is a, c, g, or t
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctgggacgaggactcgaggtggatggggatggatcgagccccttaacaacgggtaaaaccacaacggactaatggacaagaaccctaccgaagggcaggattcaaccatcgaacgacagacaacatacaacgaacacacacctaacagtggaaggngaggagcctagagatactagacgacgaccggtaccgtagtacttagttcgaggtcgacgaggttagggaggttacggacgtaaggtaggaacttacggttaccgaaacgttaaagtttaaccgtaaccttaagtttaaccgg

SEQ ID NO: 263435 - DNA, 539 bp, Homo sapiens
  misc_feature: GYAE6OF02F79UI.13.73.G07.1.454.CMB.1.raw
  modified_base (448)..(448): a, c, t, g, unknown or other
  misc_feature (448)..(448): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(539): a, c, t, g, unknown or other
  misc_feature (529)..(539): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctgtaccaacaccacccaggcaacggcccccagagtcatcatttagtgggggcaataggcggccgtcagggatttccactcgtcttctctgcctcaagtctgcaacacggcctccctgactaactctctggtcctaccgaggctgaggacgaggctcgccttattactcgctgcctgatagcgtcgtagtttcttgttgttcgggttccgttcgggccgggtaggtacctaaggtccgtaccgtccgtaggtcacgccgaacgcctaccgtccccgtcgtccnccttccttccgttcccctaccctcctctacggttcgtcgacgtcggcgcggtcgtggacgacggcgactagcgnngncngnnnnnnnnnnn

SEQ ID NO: 263436 - DNA, 808 bp, Homo sapiens
  misc_feature: GYAE6OF02G37DW.13.73.G07.1.454.CMB.1.raw
  modified_base (426)..(426): a, c, t, g, unknown or other
  misc_feature (426)..(426): n is a, c, g, or t
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctcatgtctggtctctggacagtcgatcaccatctctgcacgtaggaaatagcagtgagttggttagggtacttagtacgtaccttgtcctacctacggtaccaaccaaccacccgaggtacaaaccgaccccaaactctaatttacgtttaacgggacaaagtacggccgcctacgaggttcctttgtagtatccgtcttcctcgttacggcctaccgttaagtccgtacggactaaaccgccgtaccctccgtanaactacttcctcggtacgacccgttaccgacgggacccggtaagggaccgtaggtaccgtttagttttaacgttttttaccgttacgggttttctttaaccgtaaagttacggttaacggtaccgggtaaagggtaaacgggttaacgttaaggtttacggttttaacgtttacgggttttaacgggttttaacgggtaaacggggtttaaaccgggtaaaaccggttaccgggttaacccgttaccccggttttacgggttaaccgggttaaccggtaccccggttaaacccgtaaccccggtaaaccccgaaccccggtttaacgttaccgtaacccgttaccgtttcccgtttaacccccggtttccccgttacccccg

SEQ ID NO: 263437 - DNA, 858 bp, Homo sapiens
  misc_feature: GYAE6OF02GR0GY.13.73.G07.1.454.CMB.1.raw
tcagtcacgtactacacgaccggtgctcgatttagctctacgctcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctctgcaaggcttcgtggttacactttagcagctattcttatcagctgggtgcgacgacggcccctagggacgaggctacggaggtggacgtggggatcgggatacgacgtaccccgtttaaacgaaaccggggtaaaaccaacgtaacggtaaccgttaagttaacggggaaccaaacggtaaaaccccgttacccggaacgggggtaacctaaaggtaacctttacccgaaaccgtaacgttaccgggaaaccgtaacgaaacggaaacccgaaccgtaaacgttaaacccgaaacccggtaaaacccaaacccgtaaaccggtaaccccgttaaaccgaacgggttaacggggtaaacgggtttacgggaaaccggggtaacggtaccccggttaaggaaaccgggtaacgttaaacggttaaccgggaaacccggtaaaccgggaacccgggttaacccggtttaagtttaaacggtttaacgttttacgggtcgtaaccgggtagggtaacggggttacggggtaacgggttaccgggtaacggtagggttaacggggttaaccgttaaaggttacccggttaaaacgttaaaaccgttttaaccgttaaccgttttaaacgtttaaacccgg

SEQ ID NO: 263438 - DNA, 729 bp, Homo sapiens
  misc_feature: GYAE6OF02FNPGQ.13.73.G07.1.454.CMB.1.raw
tcagtcacgtactacacgaccggtgctcgatttagctctacgctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccattcctcctgcactggaaacagcagtgatgttgggacttatcgtaccttgtctcgtcggtaccgacaaccacccgaggaccaaaacgaccccccaaactctaatttacgtttaccggggtactaaagtaacgccggccccttacgaggggtccttttctcgtacttccgtaccttctcgtcggtcctacctaagttcctggacctaaccgaccggcccttccctcgaactacgtccctctcggggtaaccctccgacggggaccgaagggtaaccgacggtcgtttacggttaaccttttttaccggtgttttcggttactaactttagtcggtacgtaagggaaaggttacggtagttaagtttacgtttaggtttcgtttagggtaagggtaccgggtaaccgtaacgggttccgtaacccggtttccgttacggtacctaaccggaccccgtaaaccggaccccgtaacccctacgttccgtaccaacccgttcccgtccgttacccccgtcccttaccccgg

SEQ ID NO: 263439 - DNA, 653 bp, Homo sapiens
  misc_feature: GYAE6OF02FT8HA.13.73.G07.1.454.CMB.1.raw
  modified_base (587)..(587): a, c, t, g, unknown or other
  misc_feature (587)..(587): n is a, c, g, or t
tcagtcacgtactacacgaccggtgctcgatttagctctacgctcaggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagtctatcttatcagcgtgggtgcgacgcggtcccccgtggacgacggtacgtcggaggtaggagtggggacgttgggatccgaacggtccccgtttaaacgaaaccgggtaaaaccacggtaacggtaaccgttaagtacggggaactaacggtaaacccgtacccggaaggggtaccaacggtactttaccgaaccgtaagtccggaaaccgacgaaggaacctaagaacgtaaccaaacgaaacccactaaccgtacctaacagttagggaggtacggaggacgtccgtagaagagttagtagacggacgacggcgtagttattagtgagngagtaggtggtaggtcggacgtaggtgtaagttagtacgaaagttaattaccgttatacgttaacg

SEQ ID NO: 263440 - DNA, 721 bp, Homo sapiens
  misc_feature: GYAE6OF02HICZQ.13.73.G07.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcagggcacagggtcctgggcccagtctgccctgactcagcctgcctccgtgtctggatctcctggacagtcatccacatctcngcactagaaacngctagtgacttcgttggacttagtacgtacttgtcttccgtacgtaccaacgaccacccgacggaccgaaccggaccccgaagcgtacactacgttaagtttacggtacggggacaacggttcgggaccggtaccgttacgtaacgggttactttacccgtacgtcgttaccttcgttacgtcggtacctaccgtaacggttccgtacggtaaccaaccgacccggtcctacccgtacgtaaccgttacttccgttaccgttcggttacccgtaccgaacgggtcgttacggaacgggaacggtcggttacgtacctaaccggttttacttaacggtgtaccgttcgtaccttagtacgttacgtccgtacgtttaccgtttcttccgttaggttcgttaccggtcgggtacgtacggttaacgtacggttaccgtacggttaccgtaggacccgtacggtaccggtcgtacccgtcccggtcccgttacgtccgttacccg

SEQ ID NO: 263441 - DNA, 742 bp, Homo sapiens
  misc_feature: GYAE6OF02FX1XA.13.73.G07.1.454.CMB.1.raw
  modified_base (302)..(302): a, c, t, g, unknown or other
  misc_feature (302)..(302): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
tcagtcacgtactacacgaccggtgctcgatttagctctacgctcaggggacccaaaaaccaacacccctccttgggagaatcccctagatcacagctcctcaccatggactggacctggagcattccttttcttggtggcagcagcaacaggtgcccactcccaggttcagctgggtgcagtcgtgcagtctggaggtgaaacgaagccgtggggtcctagagtgaaagacttcgtcctagacgaacggtctttcgttacgggttaacctaccgttttaagccgacgtcttactcctttancctaaggtcgttgggtcgaccgtacgaccggtccccgtagggaccgtaggactcggaggtggacgtgggtagtggtactccgaccgtccttaaacgaacggtaaacacgagtactagtcggaanaccgacctacgaggtcaacgtntaccgacatacggactaacgagaacacgactaacaaccgtaacacgacgctaacgtgtaggtaacggagtaacgggctaaccgtggtaacgtacgttaaggaccgtacggtaaccggttacgggtaccgtttaacgttacgtttaccggttcggaagtaccggtaagggttaacggtaccgggggttcgaacgggtacgggttaaacgggttacggtaacggtttaaaccggtaaccggtttaaaaccggttaaccgtttaaacgttttaaccggtaaccgttttaaaccgggg

SEQ ID NO: 263442 - DNA, 737 bp, Homo sapiens
  misc_feature: GYAE6OF02HE8X4.13.73.G07.1.454.CMB.1.raw
  modified_base (616)..(616): a, c, t, g, unknown or other
  misc_feature (616)..(616): n is a, c, g, or t
tcagtcacgtactacacgaccggtgctcgatttagctctacgctcaggggggggtcgacaagaggcagcgctctcgggacgtctccaccatggcctgggctctgctgctcctcactctcctcactcaggacacagggtcctgggccccagtctgccctgactcagcctgcctccatgtctgggtctcctggacagtcgactcgaccatcgtcctgctactggaaaatggcaggtgagtggttgggaactttagtcgacttgtcctccgtggttaccgaactaaccgaccccgaggaccgaaaaccgaccccctaaaagtaccaagttacgtacgttttaagtcgtaagttacggtaacaaggtaaaccgtaccgggacccgttcggaaccggggttaccctaggttacctcgttaccttcgtcctacggtaacctaccggacgtttccgacggacctaaacgccggtaccctcccgtacgtacccagttaccgtcgttcgggacccctcgaacgggtgtacggagtacgtaggtacgttacgttaaggttaacttaactaaccgttgtcgtacgttactacgtaagtccgtaggtacgaccgtagtaacccggtanaacgttaccggttataacccggttagggttaccgggtaacggtacggggttaacctaaacgggttccgtaaccccgttcggtaacgggttaccgaaccccgggttacccgacggtaccccg

SEQ ID NO: 263443 - DNA, 782 bp, Homo sapiens
  misc_feature: GYAE6OF02JTECN.13.73.G07.1.454.CMB.1.raw
  modified_base (221)..(221): a, c, t, g, unknown or other
  misc_feature (221)..(221): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcgaggacacgagggtcctgggcccagttctcgccctgactcagcctgcctccattgtcgtgggtctccgtaggacaggtcatccacctatccgttccngacctacgtaggaaactcggctaggttgattggttaggtacctttagtccgtacttcgtccttccgtacggtaaccaaccaacccgacccgaaggtaccaaaacccggtacccctaaactcgttaaacgttttacgtttaaccggggaactaacggttaaaccggcccggtaccctacggtacggggttccttttaccggtagtaacgttccgttccgtttcgtcggtcggtacctaccgtaacggttcgtcggtaaccaacggtccggtccctacgtagaacctacgtttcctacgtacgaccgttaccggacgggaccggtacgggaccgttagggtacccgttaagtttaccgtttttagttacggttcttttacgaatacggtacgtaggtaacgggttaaggtaccgttagttaacgtttgtaaccggtttcgggtaacggtaacggtacgggtaaacccgtgtacccgttaccgtggttccggaacgtaccgacccggtaccacccgttaaccgtcgacgtttaccccacggtttcccttacccggtccctcccg

SEQ ID NO: 263444 - DNA, 722 bp, Homo sapiens
  misc_feature: GYAE6OF02F8ENL.13.73.G07.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
tcagtcacgtactacacgaccggtgctcgatttagctctacgctcagggggggttcacaagaggcagcgctctcgggacgtctccaccagtggcctgggctctgctgctcctcactctcctcactcaggacacagggtcctgggcccagtctgccctgactcagcctgcctccatgtctgggtctctggacngtcgatcacctntctcctgccacgtaggaaactcgcaggttcgattcggttcggacttatcgaccttgtctccgtggtacctaacaaccacccgaggaccaaacgcccccaaatccatttacgttacggtacaaacgtacgcggtccctgacgggtctttcgngtactccgtcttctcgtcggtacctccgtaagtccgtacggaccaaccgaccggtccctacccgtacgactaacttctacggtacgtccgtccgacggccggtacgggtacgcggtaccgttagttaccgtttttacggtcggttttacgttactaacgtttacgacggacgtaaggggtaaacgttggtacgttaacgtttacgttcggtttaacgttacgggggtaaactacggggtaacctacgggttaccgtacccggttccgttacgggtaaccgaacccggtaccccgtaaaccggtaccccgtaaccccgtacgttcggtaacccctacgttcccggttacccggttccccgtaccccgg

SEQ ID NO: 263445 - DNA, 775 bp, Homo sapiens
  misc_feature: GYAE6OF02G63V3.13.73.G07.1.454.CMB.1.raw
tcagtcacgtactacacgaccggtgctcgatttagctctacgctcaggggggggggtcacaagaggcagcgctctcgggacgtctccaccatggcctgggctctgctgctcctcactctcctcactcaggacacagggtcctgggcccagtctgccctgactcagcctgcctcatgtctgggtctctgacagtcgatcaccatcctcctgcacgtaggaaatagcagtgtaagttcgggttaggacttagtcgttaccgttcgttaccttccgttacggtaacccgaaccaaccgtaaccccgaacggaacctaaaccggtaaccccctaaaaccgttaccttaaacgttttaacggtttaaccggggtaactaaaacggttaaccgggacccggtacccgtacggtaacgggttccttttacgtacgtaacgttccgtacctttccgtccgttacgggtaccttaccgtaaacgttccgtacggaacctaaccggtacccgtaccctacccgtaacgtaacctaaccgtttccgttacgtaccggtaccctaccggtaacgggaacccggtagggaaccgaggtacttaggtttactttttacgtgttttacgtacgttaagtacgtcgtaacggtaaggtaacggtagttagttagtttaacgttcggttaacgtttagggaacggttacgaaccgttacggtaccgtacgttcggtacgactaccggaccgaaccgacctaccgacttcgacctctcgtacccgtccctacc

SEQ ID NO: 263446 - DNA, 714 bp, Homo sapiens
  misc_feature: GYAE6OF02FKXA5.13.73.G07.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
tcagtcacgtactacacgaccggtgctcgatttagctctacgctcaggggggggtcacaagaggcagcgctctcgggacgtctccaccatggcctgggctctgctgctcctcactctcctcactcacggacacagggtcctgggcccagtctgccctgactcagcctgcctccatgtctggtctcctggacagtcgatcaccntcctcctgcacgtaggaaatgctaggtacgattcggttagggactttagtcgtaccttgtcctccgtaggtaaccacaaccaccaggacaaaccgcccctaaatctaagttacgttacgggtacaagtaacggccggaccctacgagggttctttcgtnacgtcgtcttcctcggttacgcctaccgaacgtcgtcggacctaaaccgtccggtcccctaccgttacgaactactccgtacgtacgaacccgtccgacgggtccggaagggaccggtagttaccgttagttaactttttacggtggtttcttacgtacgttagtcggtacgtaaagggtaaggtacgttaggtacgtttacgtcgggtttatttaacggggaacgttacgggtaaccgtaacgggttccgtaccggttcggttacggtacccgaacgtaccccggaacggtacccctaaaccccgtgttaccgtacccttaaccggttccgttacccggtccccgtaaccc

SEQ ID NO: 263447 - DNA, 713 bp, Homo sapiens
  misc_feature: GYAE6OF02GT0P6.13.73.G07.1.454.CMB.1.raw
  modified_base (262)..(262): a, c, t, g, unknown or other
  misc_feature (262)..(262): n is a, c, g, or t
tcagtcacgtactacacgaccggtgctcgatttagctctacgctcagggggggtcacaagaggcagcgctctcgggacgtctccaccatggcctgggctctgctgctcctcactctcctcactcgaggacacgagggtcctgggcccagtctgccctgactcagcctgcctccattgtccgtgggtcctccgtaggactacgtcgatccacctacttcctccgtgccacgtaaggaaatcgctagtgagttggtaggacttntcgtacttgtcgtcctagtaaccactaccaccgagaccaaaccgaccccaattcgtaacgtttacggttacggacaagtaccgaccggtcctaggtacggtctttgtacgtcgtcgttcttcgcgtacgtaccttacgacgttcgacgtaaccgaccgtccgtccctaccgaagtacctacgttctaacgtcgtaccctccgaacgggcgtaacgggacgtgttacgttaccgtttagttttccgttggttactaactagtacgtacggaggtaagggaacgttggtaacttagttttagacggtttagttaacggggtaacgttacggaaaccgttacggttcctacccggtttcggttaaccggcgttaacccggaacccgtttaaccggaccccgttaaaccctcgttacgttacccgtccgttacccgttcccggacccttaccccg

SEQ ID NO: 263448 - DNA, 527 bp, Homo sapiens
  misc_feature: GYAE6OF02H1RDS.13.73.G07.1.454.CMB.1.raw
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (509)..(509): a, c, t, g, unknown or other
  misc_feature (509)..(509): n is a, c, g, or t
  modified_base (513)..(527): a, c, t, g, unknown or other
  misc_feature (513)..(527): n is a, c, g, or t
tcagtcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttagtgggggcaagtaggcggccgtcaggggtactttccatccgcttctcgttggctccaagtctggcaacacggtcctcctgacaatctctggtctccgaggctgaggcgaggctgcctattacgngcgtgctacnttatgctgtttctcgtgtcgtcgtcggcggtaggtacgtaagttcgaccgtccgtaggtccacggccctaaggctacccgccccgtcggtcctaccttccgttccgttccctcccttctcgtacgttcgtcgacgttgacggcgggctcggctaacggcagatancgtnnnnnnnnnnnnnnn

SEQ ID NO: 263449 - DNA, 546 bp, Homo sapiens
  misc_feature: GYAE6OF02GG9FG.13.73.G07.1.454.CMB.1.raw
  modified_base (329)..(329): a, c, t, g, unknown or other
  misc_feature (329)..(329): n is a, c, g, or t
  modified_base (533)..(533): a, c, t, g, unknown or other
  misc_feature (533)..(533): n is a, c, g, or t
  modified_base (536)..(538): a, c, t, g, unknown or other
  misc_feature (536)..(538): n is a, c, g, or t
  modified_base (540)..(541): a, c, t, g, unknown or other
  misc_feature (540)..(541): n is a, c, g, or t
  modified_base (545)..(546): a, c, t, g, unknown or other
  misc_feature (545)..(546): n is a, c, g, or t
tcagtcacgtactacacgaccggtgctcgatttagctctacgctcagggtccgtgggcccagtctgccctgactcagcctgcctccgtgtctgggtctcctggacagtcgatcaccatctcctgcactggaaacagcagtgatcttgggacttatagaccttgtctcctggtaccaacaccacccaggcaagggcccccagagtcatcatttatgggggcaatagggcggccgtcagggatttccatcgcttctctggctccaagtctggcaacacggcctccctgacatctctggtctccaggctgaggcgaggctgcctagttaccngctagctcatatgctagttctctgtgtcttaggcggtaggtccaagtcgaccgtctagtcacgtcccgaaggccttacggccccctaggtctacttacgttcgttccccgtcccttaccgtcttaacggtaccggttcgaaccgttcgggacggtccggggtaccttgggacctaaacgggcgcgtagtagccaggtcacgttncgnnncnnatcnn

SEQ ID NO: 263450 - DNA, 783 bp, Homo sapiens
  misc_feature: GYAE6OF02IMN60.13.73.G07.1.454.CMB.1.raw
  modified_base (536)..(536): a, c, t, g, unknown or other
  misc_feature (536)..(536): n is a, c, g, or t
  modified_base (748)..(748): a, c, t, g, unknown or other
  misc_feature (748)..(748): n is a, c, g, or t
  modified_base (775)..(775): a, c, t, g, unknown or other
  misc_feature (775)..(775): n is a, c, g, or t
  modified_base (779)..(779): a, c, t, g, unknown or other
  misc_feature (779)..(779): n is a, c, g, or t
  modified_base (781)..(782): a, c, t, g, unknown or other
  misc_feature (781)..(782): n is a, c, g, or t
tcagtcacgtactacacgaccggtgctcgattttagctctacgctcagggtcctgggcccagtctgccctgactcagcctgcctccgtgtctgggtctccgtggacagtcgactcaccatctcctgcactaggaaacagcagtgattcgttgggtactttatagtactttcgtccttcccgttaggtaacccaaaccacccaaccccgtaagggaccgaaccgggaccccccgaaggtaccggttacctaacgttaccgttaaagtttttaacgggtcggggggtaacctaaaacgggttaccgggggacccgggtccgggttaaccggtaacgggggttacctttttaccccgaccgttccggttcctttacctttccggtcggtacccttaccggtaaacgtttccggtacggaccgaaaccgtaccggtcccctcccgtaggtaacctaactccgttacgttcggtccttaccgaggtactgggaacggacggacgtcgtacggtaccttagttaccgtcgtcttgaccttanacgtacgttcgtacgttcggttttacgttcgttacggtcgtttacggtcggggtacggtacggtaacgtaacgtacgtaccgtcggtacgtcaacgtcgaacgtccgtacccgtcccgtacgtcctacgttccttaccgtccctacccgttaccgtacttcgtacgtcgtacgtcgacggccggcgtacgacggtaacgcgtacaagtcgtncgtaagtccagcgattccggatccganctancnnc

SEQ ID NO: 263451 - DNA, 279 bp, Homo sapiens
  misc_feature: GYAE6OF01ELP4X.24.53.E09.1.454.CMB.1.raw
  modified_base (278)..(279): a, c, t, g, unknown or other
  misc_feature (278)..(279): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263452 - DNA, 278 bp, Homo sapiens
  misc_feature: GYAE6OF01CLC6X.24.53.E09.1.454.CMB.1.raw
  modified_base (278)..(278): a, c, t, g, unknown or other
  misc_feature (278)..(278): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagn

SEQ ID NO: 263453 - DNA, 280 bp, Homo sapiens
  misc_feature: GYAE6OF01EA9SI.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263454 - DNA, 322 bp, Homo sapiens
  misc_feature: GYAE6OF01DVR68.24.53.E09.1.454.CMB.1.raw
  modified_base (288)..(322): a, c, t, g, unknown or other
  misc_feature (288)..(322): n is a, c, g, or t
tcagactactatgtcacgaccggtgctcgatttagagagagtgtgttgggtttgggggtgtggtggtctccactcccggcccttgacgggctgctagtctgcctcgctggccatcacctgggctccaggctgaggatgaggtgacttactactgccagtccgtcgaagatgttcggcggagggactaagctgaccgtcctaggtcagcccaaggcctgcccctcggtcactctgttcccgccctcctctacatagtagtctgagcgggactgggcaaggccgcatagnnnnnnnnnnnnnnnnnnnnnnnnnnnnnnnnnnn

SEQ ID NO: 263455 - DNA, 280 bp, Homo sapiens
  misc_feature: GYAE6OF01EKJL9.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnn

SEQ ID NO: 263456 - DNA, 274 bp, Homo sapiens
  misc_feature: GYAE6OF01BMA4F.24.53.E09.1.454.CMB.1.raw
  modified_base (273)..(274): a, c, t, g, unknown or other
  misc_feature (273)..(274): n is a, c, g, or t
tcagactactatgtcacgaccggtgctcgatttagagagagtgtgttgggtttggggtgtggtggtctccactccgccttgacgggctgctatctgcctcgctggccatcactggctccaggctgaggatgaggtgattactactgccagtcgtcgaagatgttcggcggaggactaagctgaccgtcctaggtcagcccaaggctgcccctcggtcactctgttcccgccctcctcacatagtagtctgagcgggctggcaaggcgcatagnn

SEQ ID NO: 263457 - DNA, 427 bp, Homo sapiens
  misc_feature: GYAE6OF01BXOIK.24.53.E09.1.454.CMB.1.raw
  modified_base (423)..(427): a, c, t, g, unknown or other
  misc_feature (423)..(427): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctcggtcactctgttcccacctcctcacatagtagtctgagcgggctggcaaggcgcatagnnnnn

SEQ ID NO: 263458 - DNA, 278 bp, Homo sapiens
  misc_feature: GYAE6OF01BNGVS.24.53.E09.1.454.CMB.1.raw
  modified_base (277)..(278): a, c, t, g, unknown or other
  misc_feature (277)..(278): n is a, c, g, or t
tcagactactatgtcacgaccggtgctcgatttagagagagtgtgttgggtttgggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263459 - DNA, 286 bp, Homo sapiens
  misc_feature: GYAE6OF01ASKQP.24.53.E09.1.454.CMB.1.raw
  modified_base (278)..(286): a, c, t, g, unknown or other
  misc_feature (278)..(286): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnnnnnn

SEQ ID NO: 263460 - DNA, 293 bp, Homo sapiens
  misc_feature: GYAE6OF01C4LWN.24.53.E09.1.454.CMB.1.raw
  modified_base (280)..(293): a, c, t, g, unknown or other
  misc_feature (280)..(293): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgcctagtcgtcgaagatgttcggcggagggactaagctgaccgtcctaggtcagcccaaggctgccccctggtcactctgttcccgccctcctcacatagtagtctgagcgggctggcaaggcgcatagnnnnnnnnnnnnnn

SEQ ID NO: 263461 - DNA, 281 bp, Homo sapiens
  misc_feature: GYAE6OF01EBJW3.24.53.E09.1.454.CMB.1.raw
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnn

SEQ ID NO: 263462 - DNA, 279 bp, Homo sapiens; identical to SEQ ID NO: 263451
  misc_feature: GYAE6OF01E0ASN.24.53.E09.1.454.CMB.1.raw
  modified_base (278)..(279): a, c, t, g, unknown or other
  misc_feature (278)..(279): n is a, c, g, or t

SEQ ID NO: 263463 - DNA, 281 bp, Homo sapiens; identical to SEQ ID NO: 263461
  misc_feature: GYAE6OF01CRZZV.24.53.E09.1.454.CMB.1.raw
  modified_base (280)..(281): a, c, t, g, unknown or other
  misc_feature (280)..(281): n is a, c, g, or t

SEQ ID NO: 263464 - DNA, 281 bp, Homo sapiens
  misc_feature: GYAE6OF01CWXQF.24.53.E09.1.454.CMB.1.raw
  modified_base (139)..(139): a, c, t, g, unknown or other
  misc_feature (139)..(139): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (272)..(281): a, c, t, g, unknown or other
  misc_feature (272)..(281): n is a, c, g, or t
tcagactactatgtcacgaccggtgctcgatttagagagagtgtggttgggtttggggtgtggtggtctccactcccgccttgacgggcgtgctatctgcctcgctggccatcactggctccaggctgaggatgaggtnattactactgccagtcgtcgaagatgttcggcgaggactaagctgaccgtctaggtcagcccaaggctgcccctggtcactctgttcccgcctcctnacatagtagtctgagcgggctggcaaggcncatagnnnnnnnnnn

SEQ ID NO: 263465 - DNA, 283 bp, Homo sapiens
  misc_feature: GYAE6OF01AQ9DS.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnnn

SEQ ID NO: 263466 - DNA, 156 bp, Homo sapiens
  misc_feature: GYAE6OF01CZ04O.24.53.E09.1.454.CMB.1.raw
  modified_base (155)..(156): a, c, t, g, unknown or other
  misc_feature (155)..(156): n is a, c, g, or t
tcagactactatgtcacgaccggtgctcgatttagagagagtgtgttgggtttgggggaagaggaagactgacggtcctgccacagcggccctgggctgcctggtcaaggactacttccacatagtagtctgagcgggctggcaaggcgcatagnn

SEQ ID NO: 263467 - DNA, 284 bp, Homo sapiens
  misc_feature: GYAE6OF01A850U.24.53.E09.1.454.CMB.1.raw
  modified_base (279)..(284): a, c, t, g, unknown or other
  misc_feature (279)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnnn

SEQ ID NO: 263468 - DNA, 317 bp, Homo sapiens
  misc_feature: GYAE6OF01A809N.24.53.E09.1.454.CMB.1.raw
  modified_base (274)..(274): a, c, t, g, unknown or other
  misc_feature (274)..(274): n is a, c, g, or t
  modified_base (280)..(317): a, c, t, g, unknown or other
  misc_feature (280)..(317): n is a, c, g, or t
tcagactactatgtcacgaccggtgctcgatttagagagagtgtgttgggtttgggggtgtggtggtctccactcccgccttgacggggctgctatctcgcctcgctcggccatcactgggctccaggctgaggatgagggtgattactactgccagtcgtcgaagatgttcggcggagggactaagctgaccgtcctaggtcaggcccaaggctgccccctggtcactctgttcccgcctcctcacatagtagtctgagcggctggcaaggcncatagnnnnnnnnnnnnnnnnnnnnnnnnnnnnnnnnnnnnnn

SEQ ID NO: 263469 - DNA, 277 bp, Homo sapiens
  misc_feature: GYAE6OF01AYG55.24.53.E09.1.454.CMB.1.raw
  modified_base (277)..(277): a, c, t, g, unknown or other
  misc_feature (277)..(277): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttcccgccctcctcacatagtagtctgagcgggctggcaaggcgcatagn

SEQ ID NO: 263470 - DNA, 294 bp, Homo sapiens
  misc_feature: GYAE6OF01BXVCA.24.53.E09.1.454.CMB.1.raw
  modified_base (279)..(294): a, c, t, g, unknown or other
  misc_feature (279)..(294): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnnnnnnnnnnnnn

SEQ ID NO: 263471 - DNA, 298 bp, Homo sapiens
  misc_feature: GYAE6OF01D1XFX.24.53.E09.1.454.CMB.1.raw
  modified_base (275)..(275): a, c, t, g, unknown or other
  misc_feature (275)..(275): n is a, c, g, or t
  modified_base (281)..(298): a, c, t, g, unknown or other
  misc_feature (281)..(298): n is a, c, g, or t
tcagactactatgtcacgaccggtgctcgatttagagagagtgtgttggggtttgggggtgtggtggtctaccactcccgccttggacggggctgctatctgcctcgctggccatcactgggctccaggctgaggatggagggtgattactactgccagtcgtcgaagatgttcggcggagggactaagctgaccgtctaggtcagcccaaggctgcccctggtcactctcgttcccacctcctcacatagtagtctgagcgggctggcaaggcncatagnnnnnnnnnnnnnnnnnn

SEQ ID NO: 263472 - DNA, 432 bp, Homo sapiens
  misc_feature: GYAE6OF01ARFWT.24.53.E09.1.454.CMB.1.raw
  modified_base (427)..(432): a, c, t, g, unknown or other
  misc_feature (427)..(432): n is a, c, g, or t
tcagactactatgtcacgaccggtgctcgatttagagagagtgtgttgggtttgggctgttttggaagctgcttgtaccagagggtcaccatctcctgcactgggagcaacatcggcgcaggttttgatgtccactggtacaagcagcttccaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtcctgagcgggctgggcaaggcgcatagnnnnnn

SEQ ID NO: 263473 - DNA, 280 bp, Homo sapiens
  misc_feature: GYAE6OF01AYNMR.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacaagtagtctgagcgggctggcaaggcgcatagnnn

SEQ ID NO: 263474 - DNA, 281 bp, Homo sapiens
  misc_feature: GYAE6OF01EUFJM.24.53.E09.1.454.CMB.1.raw
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnn

SEQ ID NO: 263475 - DNA, 427 bp, Homo sapiens
  misc_feature: GYAE6OF01CHKFL.24.53.E09.1.454.CMB.1.raw
  modified_base (423)..(427): a, c, t, g, unknown or other
  misc_feature (423)..(427): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttaccaaaaacagcccccaaaactcctcatttatcgtaaacaacaatcggccctctggggtccctgaccgattctccgcctccaagtctggcacctcagcctcgctggccatcactgggctccaggctgaggatgagggtgattactactgccagtcgtcgaagatgttcggcggaggactaagctgaccgtccaggtcagcccaaggctgcccctggtcactctgtcccaccctctcacatagtagtctgagcgggctggcaaggcgcatagnnnnn

SEQ ID NO: 263476 - DNA, 280 bp, Homo sapiens
  misc_feature: GYAE6OF01DMCZ7.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagn

SEQ ID NO: 263477 - DNA, 511 bp, Homo sapiens
  misc_feature: GYAE6OF01C1ZNB.24.53.E09.1.454.CMB.1.raw
  modified_base (432)..(432): a, c, t, g, unknown or other
  misc_feature (432)..(432): n is a, c, g, or t
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatactccagcattggggccagggcaccctggtcaccgtctacctcagcctccaccaagggcccatcgtcctcccctggccnccctgctccaggacgcacctccgagacgcacgagccggccctgggcctgcctggcaaggactactccacatagtgtctg

SEQ ID NO: 263478 - DNA, 282 bp, Homo sapiens
  misc_feature: GYAE6OF01AMPW7.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnn

SEQ ID NO: 263479 - DNA, 280 bp, Homo sapiens
  misc_feature: GYAE6OF01DXEDG.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263480 - DNA, 290 bp, Homo sapiens
  misc_feature: GYAE6OF01A6WQJ.24.53.E09.1.454.CMB.1.raw
  modified_base (279)..(290): a, c, t, g, unknown or other
  misc_feature (279)..(290): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagttcgtcgaagatgttcggcggagggactaagctgaccgtcctaggtcagcccaaggctgccccctggtcactctgttcccaccctcctcacatagtagtctgagcgggctggcaaggcgcatagnnnnnnnnnnnn

SEQ ID NO: 263481 - DNA, 510 bp, Homo sapiens
  misc_feature: GYAE6OF01AQ5XE.24.53.E09.1.454.CMB.1.raw
tcagactactatgtcacgaccggtgctcgatttagagagagtgtgttgggtttgggaggcttggtccagcctgggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggccagggcaccctggtcaccgtctcctcagcctccaccaaggcccatccggtcttccccctggccgccctgctccaggacgcacctccgagacgcacagcgccctgggctgcctggtcaaggactacttccacatagtgtctgg

SEQ ID NO: 263482 - DNA, 282 bp, Homo sapiens
  misc_feature: GYAE6OF01A62KA.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnn

SEQ ID NO: 263483 - DNA, 279 bp, Homo sapiens
  misc_feature: GYAE6OF01BXQF3.24.53.E09.1.454.CMB.1.raw
  modified_base (277)..(279): a, c, t, g, unknown or other
  misc_feature (277)..(279): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnn

SEQ ID NO: 263484 - DNA, 280 bp, Homo sapiens; identical to SEQ ID NO: 263476
  misc_feature: GYAE6OF01ET39T.24.53.E09.1.454.CMB.1.raw
  modified_base (280)..(280): a, c, t, g, unknown or other
  misc_feature (280)..(280): n is a, c, g, or t

SEQ ID NO: 263485 - DNA, 281 bp, Homo sapiens
  misc_feature: GYAE6OF01DNVNM.24.53.E09.1.454.CMB.1.raw
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263486 - DNA, 316 bp, Homo sapiens
  misc_feature: GYAE6OF01CQODW.24.53.E09.1.454.CMB.1.raw
  modified_base (276)..(276): a, c, t, g, unknown or other
  misc_feature (276)..(276): n is a, c, g, or t
  modified_base (282)..(316): a, c, t, g, unknown or other
  misc_feature (282)..(316): n is a, c, g, or t
tcagactactatgtcacgaccggtgctcgatttagagagagtgtgttgggtttgggggtgtggtggtctcccactcccgtccttgacgggctgctatctgcctcgctggccatcactgggctccaggctgaggatgagggtgattactacgtgccagtcgtcgaagatgttcggcggagggactaagctgaccgtcctaggtcagcccaaggctgccccctcggtcactctgttcccaccctcctcacatagtagtctgagcgggctggcaaggcncatagnnnnnnnnnnnnnnnnnnnnnnnnnnnnnnnnnnn

SEQ ID NO: 263487 - DNA, 434 bp, Homo sapiens
  misc_feature: GYAE6OF01EFW08.24.53.E09.1.454.CMB.1.raw
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctcgttcccaccctcctcacatagtagtctgagcgggctggcaaggcgcatagnnnnnnnnn

SEQ ID NO: 263488 - DNA, 280 bp, Homo sapiens
  misc_feature: GYAE6OF01BIOZH.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagn

SEQ ID NO: 263489 - DNA, 445 bp, Homo sapiens
  misc_feature: GYAE6OF01BNJGX.24.53.E09.1.454.CMB.1.raw
  modified_base (162)..(162): a, c, t, g, unknown or other
  misc_feature (162)..(162): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (412)..(412): a, c, t, g, unknown or other
  misc_feature (412)..(412): n is a, c, g, or t
  modified_base (418)..(445): a, c, t, g, unknown or other
  misc_feature (418)..(445): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgcccccaaatcctcatttatcgtaacaacaatccggccctcgtggggtccctgaccgattctcgcctcaagtctggcactcagcctcgctggccatcactggctccaggctgagatgaggtnattacatgccagtcgtcgaagntggtcggnggaggactaagctgaccgtctaggtcagccaaggctcgcccctggtcactctcgtcccacctcncacatagtagtctggacgcgggctggcaaggcncagtgnnnnnnnnnnnnnnnnnnnnnnnnnnnn

SEQ ID NO: 263490 - DNA, 282 bp, Homo sapiens
  misc_feature: GYAE6OF01CHV1V.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnn

SEQ ID NO: 263491 - DNA, 280 bp, Homo sapiens
  misc_feature: GYAE6OF01D5HQQ.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnn

SEQ ID NO: 263492 - DNA, 382 bp, Homo sapiens
  misc_feature: GYAE6OF01EXCVZ.24.53.E09.1.454.CMB.1.raw
  modified_base (376)..(382): a, c, t, g, unknown or other
  misc_feature (376)..(382): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctgttccccacctcctcacatagtagtctgagcgggctaggcaaggcgctatagnnnnnnn

SEQ ID NO: 263493 - DNA, 440 bp, Homo sapiens
  misc_feature: GYAE6OF01D7A15.24.53.E09.1.454.CMB.1.raw
  modified_base (421)..(421): a, c, t, g, unknown or other
  misc_feature (421)..(421): n is a, c, g, or t
  modified_base (427)..(440): a, c, t, g, unknown or other
  misc_feature (427)..(440): n is a, c, g, or t
tcagactactatgtcacgaccggtgctcgatttagagagagtgtgttgggttggggctgttttggaagctgcttgtaccagagggtcaccatctccctgcactcgggagcaacatcggcgcaggttttgatgtccactggtacaagcagcttccaaaaacagcccccaaaactcctcatttatcgtaacaacaatcggccctctggggtccctgaccgattctccgcctccaagtctggcacctcagcctcgctggccatcactggctccaggctgaggatgagggtgattactactgccaggtcgtcgaagatgttcggcggagggactaagctgaccgtctaggtcagcccaaggctgccccctggtcactctcgtcccaccctcctcacatagtagtctggagcgggctggcaaggcncatagnnnnnnnnnnnnnn

SEQ ID NO: 263494 - DNA, 329 bp, Homo sapiens
  misc_feature: GYAE6OF01B7DBC.24.53.E09.1.454.CMB.1.raw
  modified_base (293)..(299): a, c, t, g, unknown or other
  misc_feature (293)..(299): n is a, c, g, or t
  modified_base (302)..(302): a, c, t, g, unknown or other
  misc_feature (302)..(302): n is a, c, g, or t
  modified_base (304)..(329): a, c, t, g, unknown or other
  misc_feature (304)..(329): n is a, c, g, or t
tcagactactatgtcacgaccggtgctcgatttagagagagtgtgttgggtttgggggtgtggtggtctccacttcccgccgttgacggggctgctatctggcctcgctggccaatcactggctccaggctgaggatgagggtgattactactgccagtcgtcgaagatgttcggcggagggactaaggctgacgtcctaggtcagcccaagggctaggccccctcggtcactctgttcccaccctcctccacagtacgtagtctgacgcggggctcggcaaggcgcatagcnnnnnnngcngnnnnnnnnnnnnnnnnnnnnnnnnnn

SEQ ID NO: 263495 - DNA, 278 bp, Homo sapiens
  misc_feature: GYAE6OF01EDYNJ.24.53.E09.1.454.CMB.1.raw
  modified_base (277)..(278): a, c, t, g, unknown or other
  misc_feature (277)..(278): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccacctcctcacatagtagtctgagcgggctggcaaggcgcatagnn

SEQ ID NO: 263496 - DNA, 279 bp, Homo sapiens; identical to SEQ ID NO: 263451
  misc_feature: GYAE6OF01A98A4.24.53.E09.1.454.CMB.1.raw
  modified_base (278)..(279): a, c, t, g, unknown or other
  misc_feature (278)..(279): n is a, c, g, or t

SEQ ID NO: 263497 - DNA, 280 bp, Homo sapiens
  misc_feature: GYAE6OF01DGALN.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacgggctgctatctgcctcgctgaccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnn

SEQ ID NO: 263498 - DNA, 319 bp, Homo sapiens
  misc_feature: GYAE6OF01CP57W.24.53.E09.1.454.CMB.1.raw
  modified_base (278)..(278): a, c, t, g, unknown or other
  misc_feature (278)..(278): n is a, c, g, or t
  modified_base (286)..(319): a, c, t, g, unknown or other
  misc_feature (286)..(319): n is a, c, g, or t
tcagactactatgtcacgaccggtgctcgatttagagagagtgtgttggggttttggggggtggtggtggtctccactcccgccttggacggggctgctatctgcctcgctggccatccactgggctccaggctgaggatgagggtgattactactgccagtcgtcgaagatgttcggcggagggactaagctgaccgtctaggtcagcccaaggctcgccccctggtcactctgttcccgcctactcacatagtagtctgagcgggctggcaaggcncactagcnnnnnnnnnnnnnnnnnnnnnnnnnnnnnnnnnn

SEQ ID NO: 263499 - DNA, 431 bp, Homo sapiens
  misc_feature: GYAE6OF01AKL6K.24.53.E09.1.454.CMB.1.raw
  modified_base (421)..(421): a, c, t, g, unknown or other
  misc_feature (421)..(421): n is a, c, g, or t
  modified_base (427)..(431): a, c, t, g, unknown or other
  misc_feature (427)..(431): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagccccaaggctgccccctggtcactctgttccccaccctcctcacatagtagtctgagcgggctggcaaggcncatagnnnnn

SEQ ID NO: 263500 - DNA, 282 bp, Homo sapiens; identical to SEQ ID NO: 263490
  misc_feature: GYAE6OF01AMCNU.24.53.E09.1.454.CMB.1.raw
  modified_base (280)..(282): a, c, t, g, unknown or other
  misc_feature (280)..(282): n is a, c, g, or t

SEQ ID NO: 263501 - DNA, 278 bp, Homo sapiens; identical to SEQ ID NO: 263452
  misc_feature: GYAE6OF01CIKIR.24.53.E09.1.454.CMB.1.raw
  modified_base (278)..(278): a, c, t, g, unknown or other
  misc_feature (278)..(278): n is a, c, g, or t

SEQ ID NO: 263502 - DNA, 297 bp, Homo sapiens
  misc_feature: GYAE6OF01C7T8E.24.53.E09.1.454.CMB.1.raw
  modified_base (287)..(287): a, c, t, g, unknown or other
  misc_feature (287)..(287): n is a, c, g, or t
  modified_base (293)..(297): a, c, t, g, unknown or other
  misc_feature (293)..(297): n is a, c, g, or t
tcagactactatgtcacgaccggtgctcgatttagagagagtgtgttgggtttgggggtggtggtggtctccactcccgccttgacgggctgctatctgcctcgctggcctatcactgggcttccaggctgaggatgagggtgtattacgtactgccagtcggtacgaagatagttcggacggagggactaagctgaccgtcctaggtcagccctaaggctcgccccctcggtcactctacgttccaccctcctcacataggtagtctgagcgggctaggcaaggcncatagnnnnn

SEQ ID NO: 263503 - DNA, 281 bp, Homo sapiens; identical to SEQ ID NO: 263461
  misc_feature: GYAE6OF01EABKT.24.53.E09.1.454.CMB.1.raw
  modified_base (280)..(281): a, c, t, g, unknown or other
  misc_feature (280)..(281): n is a, c, g, or t

SEQ ID NO: 263504 - DNA, 437 bp, Homo sapiens
  misc_feature: GYAE6OF01BC35B.24.53.E09.1.454.CMB.1.raw
  modified_base (161)..(161): a, c, t, g, unknown or other
  misc_feature (161)..(161): n is a, c, g, or t
  modified_base (420)..(420): a, c, t, g, unknown or other
  misc_feature (420)..(420): n is a, c, g, or t
  modified_base (426)..(437): a, c, t, g, unknown or other
  misc_feature (426)..(437): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctcggtcactctgttcccaccctcctcacatagtacgtctgagcgggctggcaaggcncatagnnnnnnnnnnnn

SEQ ID NO: 263505 - DNA, 463 bp, Homo sapiens
  misc_feature: GYAE6OF01DD915.24.53.E09.1.454.CMB.1.raw
  modified_base (434)..(463): a, c, t, g, unknown or other
  misc_feature (434)..(463): n is a, c, g, or t
tcagactactatgtcacgaccggtgctcgatttagagagagtgtgttgagtttgggggctgttttggaagctcgcttgtaccagagggtcaccatctcctgccactgggagcaacactcggcgcaggttttgatgtccactggtacaagcagcttccaaaaacagtcccccaaaactcctcatttatcgtaacaacaatcggccctctggggtccctgaccgattctccgcctccaagtctggcacctcagcctcgctggccatcactggctccaggctgaggatgagggtgattactactgccagtccgtcgaagatgttcgcggagggactaaagctgaccgtcaggtcagcccaaaggctgccccctggtcactctgttccccgccctcctcacatacgtagtctgagcgggctgggacaaggcgcatagnnnnnnnnnnnnnnnnnnnnnnnnnnnnnn

SEQ ID NO: 263506 - DNA, 429 bp, Homo sapiens
  misc_feature: GYAE6OF01AWP5Z.24.53.E09.1.454.CMB.1.raw
  modified_base (426)..(429): a, c, t, g, unknown or other
  misc_feature (426)..(429): n is a, c, g, or t
tcagactactatgtcacgaccggtgctcgatttagagagagtgtgttgggtttggggactgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnn

SEQ ID NO: 263507 - DNA, 279 bp, Homo sapiens
  misc_feature: GYAE6OF01A8EL0.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatag

SEQ ID NO: 263508 - DNA, 283 bp, Homo sapiens
  misc_feature: GYAE6OF01DXVZ4.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnn

SEQ ID NO: 263509 - DNA, 282 bp, Homo sapiens
  misc_feature: GYAE6OF01A4CXG.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnn

SEQ ID NO: 263510 - DNA, 464 bp, Homo sapiens
  misc_feature: GYAE6OF01CM9QZ.24.53.E09.1.454.CMB.1.raw
  modified_base (161)..(161): a, c, t, g, unknown or other
  misc_feature (161)..(161): n is a, c, g, or t
  modified_base (294)..(294): a, c, t, g, unknown or other
  misc_feature (294)..(294): n is a, c, g, or t
  modified_base (441)..(464): a, c, t, g, unknown or other
  misc_feature (441)..(464): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagacttccaaaaacngcccccaaaactcctcatttactcgtaacaacaatccggccctctggggtccctgaccgattctccgcctccaagtcctggcacctcagcctcgctggccatcactgggctccaggctgaaggatagagggtnacttactactgccagtcgtgaagatgttcggcggagggaactaaggcctgaccgtctaggtcagcccaaaggctgcccctggtcactctcgttcccaccctctacacgtatagtatctgagcggggctggacaaggcgtacataagnnnnnnnnnnnnnnnnnnnnnnnn

SEQ ID NO: 263511 - DNA, 293 bp, Homo sapiens
  misc_feature: GYAE6OF01BNR9T.24.53.E09.1.454.CMB.1.raw
  modified_base (289)..(293): a, c, t, g, unknown or other
  misc_feature (289)..(293): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggcctcgccccctcggtcactctcgttccccaccctcctcacatagtagtctggaggcgggctggacgaaggcgacatagnnnnn

SEQ ID NO: 263512 - DNA, 280 bp, Homo sapiens; identical to SEQ ID NO: 263491
  misc_feature: GYAE6OF01C4USX.24.53.E09.1.454.CMB.1.raw
  modified_base (279)..(280): a, c, t, g, unknown or other
  misc_feature (279)..(280): n is a, c, g, or t

SEQ ID NO: 263513 - DNA, 385 bp, Homo sapiens
  misc_feature: GYAE6OF01D3DFT.24.53.E09.1.454.CMB.1.raw
  modified_base (378)..(385): a, c, t, g, unknown or other
  misc_feature (378)..(385): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtctgagcgggctggcaaggcgcatagnnnnnnnn

SEQ ID NO: 263514 - DNA, 284 bp, Homo sapiens
  misc_feature: GYAE6OF01C039N.24.53.E09.1.454.CMB.1.raw
  modified_base (280)..(284): a, c, t, g, unknown or other
  misc_feature (280)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnn

SEQ ID NO: 263515 - DNA, 377 bp, Homo sapiens
  misc_feature: GYAE6OF01EKCFB.24.53.E09.1.454.CMB.1.raw
  modified_base (374)..(377): a, c, t, g, unknown or other
  misc_feature (374)..(377): n is a, c, g, or t
tcagactactatgtcacgaccggtgctcgatttagagagagtgtgttgggtttgggagcaacatcggcgcaggttttgatgtccactggtacaagcagcttccaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctcggtcactctgttcccaccctcctcacatagtagtctgagcgggctggcaaggcgcatagnnnn

SEQ ID NO: 263516 - DNA, 280 bp, Homo sapiens; identical to SEQ ID NO: 263488
  misc_feature: GYAE6OF01BOHI0.24.53.E09.1.454.CMB.1.raw
  modified_base (280)..(280): a, c, t, g, unknown or other
  misc_feature (280)..(280): n is a, c, g, or t

SEQ ID NO: 263517 - DNA, 281 bp, Homo sapiens; identical to SEQ ID NO: 263461
  misc_feature: GYAE6OF01CTXLX.24.53.E09.1.454.CMB.1.raw
  modified_base (280)..(281): a, c, t, g, unknown or other
  misc_feature (280)..(281): n is a, c, g, or t

SEQ ID NO: 263518 - DNA, 289 bp, Homo sapiens
  misc_feature: GYAE6OF01EFRZ5.24.53.E09.1.454.CMB.1.raw
  modified_base (272)..(272): a, c, t, g, unknown or other
  misc_feature (272)..(272): n is a, c, g, or t
  modified_base (278)..(289): a, c, t, g, unknown or other
  misc_feature (278)..(289): n is a, c, g, or t
tcagactactatgtcacgaccggtgctcgatttagagagagtgtggttgggtttgggggtgtggtggtctccactcccgccttgacgggctgctatctgcctcgctggccatcactgggctccaggctgaggatgagggtgattactactgccagtcgtcgaagatgttcggcggagggctaagctgaccgtctaggtcagcccaaggctgccccctggtcactctgttccccgccctcctcacatagtagtctgagcgggctggcaaggcncatagnnnnnnnnnnnn

SEQ ID NO: 263519 - DNA, 443 bp, Homo sapiens
  misc_feature: GYAE6OF01B82OX.24.53.E09.1.454.CMB.1.raw
  modified_base (160)..(160): a, c, t, g, unknown or other
  misc_feature (160)..(160): n is a, c, g, or t
  modified_base (426)..(443): a, c, t, g, unknown or other
  misc_feature (426)..(443): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtcctaggtcagcccaaggctcgcccctggtcactctgttccccaccctcctcacatagtagtctgagcgggctggcaaggcgcatagnnnnnnnnnnnnnnnnnn

SEQ ID NO: 263520 - DNA, 279 bp, Homo sapiens
  misc_feature: GYAE6OF01A0X8X.24.53.E09.1.454.CMB.1.raw
  modified_base (278)..(279): a, c, t, g, unknown or other
  misc_feature (278)..(279): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnn

SEQ ID NO: 263521 - DNA, 429 bp, Homo sapiens
  misc_feature: GYAE6OF01B1LZR.24.53.E09.1.454.CMB.1.raw
  modified_base (424)..(429): a, c, t, g, unknown or other
  misc_feature (424)..(429): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggtgattactactgccagtcgtcgaagatgttcggcggagggactaagctgaccgtcctaggtcagcccaaggctgccccctggtcactctgttccccacctcctcacatagtagtctgagcgggctggcaaggcgcatagnnnnnn

SEQ ID NO: 263522 - DNA, 282 bp, Homo sapiens
  misc_feature: GYAE6OF01DB44M.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgacccctcggtcactctcgttcccgccctcctcacatagtagtctgagcgggctggcaaggcgcatagnn

SEQ ID NO: 263523 - DNA, 281 bp, Homo sapiens
  misc_feature: GYAE6OF01EKVC6.24.53.E09.1.454.CMB.1.raw
  modified_base (281)..(281): a, c, t, g, unknown or other
  misc_feature (281)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagn

SEQ ID NO: 263524 - DNA, 279 bp, Homo sapiens
  misc_feature: GYAE6OF01DMSUR.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctctcacatagtagtctgagcgggctggcaaggcgcatagn

SEQ ID NO: 263525 - DNA, 389 bp, Homo sapiens
  misc_feature: GYAE6OF01B2HPI.24.53.E09.1.454.CMB.1.raw
  modified_base (238)..(238): a, c, t, g, unknown or other
  misc_feature (238)..(238): n is a, c, g, or t
  modified_base (382)..(389): a, c, t, g, unknown or other
  misc_feature (382)..(389): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtnattactactgccagtcgtacgaagatgttcggcggagggactaagctgaccgtcctaggtcagcccaaggctcgccccctcggtcactctcgttccccaccctcctcacatagtagtctgagcgggctggcaaggcgcagtagnnnnnnnn

SEQ ID NO: 263526 - DNA, 408 bp, Homo sapiens
  misc_feature: GYAE6OF01ARATK.24.53.E09.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
  modified_base (394)..(408): a, c, t, g, unknown or other
  misc_feature (394)..(408): n is a, c, g, or t
tcagactactatgtcacgaccggtgctcgatttagagagagtgtgttagggtttgggggtgtggtggtctccacttcccgccgttgacggggctgctatcctggcctcgcctggccaatcacctggctccgaggctgaggatgagggtgattactactgccagtcgtcgaagtatgttcggcggagggactaaggctgaccgtcctaggtcagcccaagggcctaggccccctggtcactctcgttcccgccctccctcacagtacgtagtcgtcgtccggcgggccgtccggacgaacggcccgacgtaagtacgctcgagngcacncgcgccgcgcgtcgcgtcgtcgacgactctcacgcnctcgtctgcgcggcgcgacgagcgcanagnnnnnnnnnnnnnnn

SEQ ID NO: 263527 - DNA, 561 bp, Homo sapiens
  misc_feature: GYAE6OF01BJU0E.24.53.E09.1.454.CMB.1.raw
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
  modified_base (504)..(505): a, c, t, g, unknown or other
  misc_feature (504)..(505): n is a, c, g, or t
  modified_base (508)..(508): a, c, t, g, unknown or other
  misc_feature (508)..(508): n is a, c, g, or t
  modified_base (512)..(514): a, c, t, g, unknown or other
  misc_feature (512)..(514): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (555)..(557): a, c, t, g, unknown or other
  misc_feature (555)..(557): n is a, c, g, or t
  modified_base (559)..(561): a, c, t, g, unknown or other
  misc_feature (559)..(561): n is a, c, g, or t
tcagactactatgtcacgaccggtgctcgatttagagagagtgtgttgggtttgggggtcgtgttttggaagctgcttgtaccagagggtcaccatctcctgcacctgggagcaacatcggcgcaggttttgatgtccactggtacaagcagcttccaaaaacngcccccaaaactcctcatttactcgtaacaacaatccggccctntggggtccctgaccgattcgtccgcctccaagtctggcacctcagcctcgctggccatcacgttgggcttacctaggtcttggaggatggaacgggtanaagtttaacctacctagcccagttcgtacgaagtattggttcggcgggaagggacttaaaggcttacggaaccggttccgtaaggtcaacgccccgaaagggtcctacggcccccgtggtcacttcctcgttccccaacctcctcaccattacgtacgtctggacgcgggtctcggtacaacggcgctaattgcatnntancgannncactcncncncncgcgngacgacgngngnananananngcnnncnnn

SEQ ID NO: 263528 - DNA, 427 bp, Homo sapiens
  misc_feature: GYAE6OF01AS3RV.24.53.E09.1.454.CMB.1.raw
  modified_base (420)..(420): a, c, t, g, unknown or other
  misc_feature (420)..(420): n is a, c, g, or t
  modified_base (425)..(427): a, c, t, g, unknown or other
  misc_feature (425)..(427): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattacactgccagtcgtcgaagatgttcggcggagggactaagctgaccgtctaggtcagcccaaggctcgccccctggtcactctcgttccccgccctcctcacatagtagtctgagcgggctggcaaggcncatgnnn

SEQ ID NO: 263529 - DNA, 281 bp, Homo sapiens; identical to SEQ ID NO: 263485
  misc_feature: GYAE6OF01CMIK8.24.53.E09.1.454.CMB.1.raw
  modified_base (280)..(281): a, c, t, g, unknown or other
  misc_feature (280)..(281): n is a, c, g, or t

SEQ ID NO: 263530 - DNA, 507 bp, Homo sapiens
  misc_feature: GYAE6OF01ATWTC.24.53.E09.1.454.CMB.1.raw
tcagactactatgtcacgaccggtgctcgatttagagagagtgtgttgggtttgggaggcttggtccagcctgggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggccagggcaccctggtcaccgtctcctcagcctccaccaagggcccatcggtcttcccctggcgccctgctccaggagcacctccgagacgcacagcggccctgggctgcctggtcaaggctacttccacatagtgtctgg

SEQ ID NO: 263531 - DNA, 281 bp, Homo sapiens; identical to SEQ ID NO: 263461
  misc_feature: GYAE6OF01A6DR7.24.53.E09.1.454.CMB.1.raw
  modified_base (280)..(281): a, c, t, g, unknown or other
  misc_feature (280)..(281): n is a, c, g, or t

SEQ ID NO: 263532 - DNA, 435 bp, Homo sapiens
  misc_feature: GYAE6OF01EWCQ3.24.53.E09.1.454.CMB.1.raw
  modified_base (430)..(435): a, c, t, g, unknown or other
  misc_feature (430)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggtcggcggagggactaagctgaccgtcctaggtcagcccaaggctcgccccctggtcactctcgtcccaccctcctcacatagtagtctgagcgggctgggcaaggcgcatagnnnnnn

SEQ ID NO: 263533 - DNA, 280 bp, Homo sapiens
  misc_feature: GYAE6OF01EAW0C.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagn

SEQ ID NO: 263534 - DNA, 432 bp, Homo sapiens
  misc_feature: GYAE6OF01DCXPC.24.53.E09.1.454.CMB.1.raw
  modified_base (428)..(432): a, c, t, g, unknown or other
  misc_feature (428)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctcgttcccaccctcctcacatagtagtctgagcgggctggcaaggcgcatagnnnnn

SEQ ID NO: 263535 - DNA, 281 bp, Homo sapiens
  misc_feature: GYAE6OF01EM9TG.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnn

SEQ ID NO: 263536 - DNA, 278 bp, Homo sapiens
  misc_feature: GYAE6OF01CMBNJ.24.53.E09.1.454.CMB.1.raw
  modified_base (278)..(278): a, c, t, g, unknown or other
  misc_feature (278)..(278): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagn

SEQ ID NO: 263537 - DNA, 431 bp, Homo sapiens
  misc_feature: GYAE6OF01AMPH7.24.53.E09.1.454.CMB.1.raw
  modified_base (418)..(418): a, c, t, g, unknown or other
  misc_feature (418)..(418): n is a, c, g, or t
  modified_base (424)..(431): a, c, t, g, unknown or other
  misc_feature (424)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgcccctggtcactctgttcccgccctcctcacatagtagtctgagcgggctggcaaggcncatagnnnnnnnn

SEQ ID NO: 263538 - DNA, 432 bp, Homo sapiens
  misc_feature: GYAE6OF01EPV6K.24.53.E09.1.454.CMB.1.raw
  modified_base (421)..(421): a, c, t, g, unknown or other
  misc_feature (421)..(421): n is a, c, g, or t
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactagctgaccgtctaggtcagcccaaggctcgccccctggtcactctcgttccccaccctcctcacatagtagtctgagcgggctggcaaggcncatagnnnnnn

SEQ ID NO: 263539 - DNA, 293 bp, Homo sapiens
  misc_feature: GYAE6OF01CN8YS.24.53.E09.1.454.CMB.1.raw
  modified_base (139)..(139): a, c, t, g, unknown or other
  misc_feature (139)..(139): n is a, c, g, or t
  modified_base (279)..(293): a, c, t, g, unknown or other
  misc_feature (279)..(293): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgaggtnattactactgccagtcgtcgaagatgttcggcggaggactaagctgacccgtcctaggtcagcccaaggctgccccctggtcactctcgttcccgccctcctcacatacgtagtctgagcgggctggcaaggcgcatagnnnnnnnnnnnnnnn

SEQ ID NO: 263540 - DNA, 288 bp, Homo sapiens
  misc_feature: GYAE6OF01BXCTE.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnnnnnn

SEQ ID NO: 263541 - DNA, 319 bp, Homo sapiens
  misc_feature: GYAE6OF01AY0TA.24.53.E09.1.454.CMB.1.raw
  modified_base (286)..(319): a, c, t, g, unknown or other
  misc_feature (286)..(319): n is a, c, g, or t
tcagactactatgtcacgaccggtgctcgatttagagagagtgtggttgggtttggggggtgtggtggtctccactcccgccttgacggggctgctatctgacctcgctggcccatcactgggctccaggctgaggatgagggtgagttactactgccagtcgtcgaagatgttcggcggagggactaagctgaccgtcctaggtcagcccaaggctcgccccctcggtcactctgttcccgccctcctcacatagtagtctgagcgggctggcaaggcgcatagnnnnnnnnnnnnnnnnnnnnnnnnnnnnnnnnnn

SEQ ID NO: 263542 - DNA, 429 bp, Homo sapiens
  misc_feature: GYAE6OF01CPHV4.24.53.E09.1.454.CMB.1.raw
  modified_base (425)..(429): a, c, t, g, unknown or other
  misc_feature (425)..(429): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnn

SEQ ID NO: 263543 - DNA, 514 bp, Homo sapiens
  misc_feature: GYAE6OF01BAADO.24.53.E09.1.454.CMB.1.raw
  modified_base (164)..(164): a, c, t, g, unknown or other
  misc_feature (164)..(164): n is a, c, g, or t
  modified_base (187)..(187): a, c, t, g, unknown or other
  misc_feature (187)..(187): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (477)..(477): a, c, t, g, unknown or other
  misc_feature (477)..(477): n is a, c, g, or t
  modified_base (481)..(487): a, c, t, g, unknown or other
  misc_feature (481)..(487): n is a, c, g, or t
  modified_base (489)..(514): a, c, t, g, unknown or other
  misc_feature (489)..(514): n is a, c, g, or t
tcagactactatgtcacgaccggtgctcgatttagagagagtgtgttgggtttgggggctggttttggaagctgcttggtaccagagggtcaccatctcctgcactgggagcaacatcggcgcaggttttgatggtccactggtacaagcagcttaccaaaacncgacccccaaatcctctatttancgtaaacaacaagtccggccctcgtcggggtccctggaccgtattcctcccgcctccaagtctggcacctnacgcctcgctggccctatcgactgggccttccgaggtctgaggtatggaggtnacttactacgtgcccgagttcggtacgaaggatggttcggnggaggactaagctgaccgtctaggtcacgcccgaaggctcgcccctggtcacgtctccgttcccaccttccncactatagtactctggacgcgggtactgggaacaacgggtcgactacgtaggncgannnnnnncnnnnnnnnnnnnnnnnnnnnnnnnnn

SEQ ID NO: 263544 - DNA, 280 bp, Homo sapiens
  misc_feature: GYAE6OF01AR1LK.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgagtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnn

SEQ ID NO: 263545 - DNA, 278 bp, Homo sapiens
  misc_feature: GYAE6OF01B2P6W.24.53.E09.1.454.CMB.1.raw
  modified_base (278)..(278): a, c, t, g, unknown or other
  misc_feature (278)..(278): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagn

SEQ ID NO: 263546 - DNA, 430 bp, Homo sapiens
  misc_feature: GYAE6OF01DHFKL.24.53.E09.1.454.CMB.1.raw
  modified_base (426)..(430): a, c, t, g, unknown or other
  misc_feature (426)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaatagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctgttcccgccctcctcacatagtagtctgagcgggctggcaaggcgcatagnnnnn

SEQ ID NO: 263547 - DNA, 280 bp, Homo sapiens
  misc_feature: GYAE6OF01CUVD1.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnn

SEQ ID NO: 263548 - DNA, 430 bp, Homo sapiens
  misc_feature: GYAE6OF01D5G43.24.53.E09.1.454.CMB.1.raw
  modified_base (420)..(420): a, c, t, g, unknown or other
  misc_feature (420)..(420): n is a, c, g, or t
  modified_base (426)..(430): a, c, t, g, unknown or other
  misc_feature (426)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctgttccccgccctcctcacatagtagtctgagcgggctggcaaggcncatagnnnnn

SEQ ID NO: 263549 - DNA, 282 bp, Homo sapiens
  misc_feature: GYAE6OF01BBNIK.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnn

SEQ ID NO: 263550 - DNA, 293 bp, Homo sapiens
  misc_feature: GYAE6OF01CIFYY.24.53.E09.1.454.CMB.1.raw
  modified_base (285)..(293): a, c, t, g, unknown or other
  misc_feature (285)..(293): n is a, c, g, or t
tcagactactatgtcacgaccggtgctcgatttagagagagtgtgttggggtttgggggtgtggtggtctccactcccgccttgacggggctgctatctgcctcgctggccatcactggctccaggctgaggatgagggtgattactactgccagtcgtcgaagatgttcggcggaggactaagctgaccgtccaggtcagcccaaggctgccccctggtcactctcgttccccgccctcctcacataggtagtctggagcgggctgggacaaggcgcaagtagnnnnnnnnn

SEQ ID NO: 263551 - DNA, 433 bp, Homo sapiens
  misc_feature: GYAE6OF01DC8P9.24.53.E09.1.454.CMB.1.raw
  modified_base (428)..(433): a, c, t, g, unknown or other
  misc_feature (428)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggtgattactactgccagtcgtcgaagatgttcggcggagggactaagctgaccgtcctaggtcagcccaaggctgccccctggtcactctcgtttcccaccctcctcacatagtagtctgagcgggctggcaaggcgcatagnnnnnn

SEQ ID NO: 263552 - DNA, 279 bp, Homo sapiens
  misc_feature: GYAE6OF01EVKEO.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagn

SEQ ID NO: 263553 - DNA, 283 bp, Homo sapiens
  misc_feature: GYAE6OF01BH7GH.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnn

SEQ ID NO: 263554 - DNA, 299 bp, Homo sapiens
  misc_feature: GYAE6OF01AGWWS.24.53.E09.1.454.CMB.1.raw
  modified_base (280)..(299): a, c, t, g, unknown or other
  misc_feature (280)..(299): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctggagcgggctggcaaggcgcatagnnnnnnnnnnnnnnnnnnnn

SEQ ID NO: 263555 - DNA, 381 bp, Homo sapiens
  misc_feature: GYAE6OF01CNH3A.24.53.E09.1.454.CMB.1.raw
  modified_base (238)..(238): a, c, t, g, unknown or other
  misc_feature (238)..(238): n is a, c, g, or t
  modified_base (374)..(381): a, c, t, g, unknown or other
  misc_feature (374)..(381): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtnattactactgccagtcgtcgaagatgttcggcggaggactaagctgaccgtctaggtcagcccaaggctgccccctggtcactctgttcccaccctcctcacatagtagtctgagcgggctggcaaggcgcatagnnnnnnnn

SEQ ID NO: 263556 - DNA, 282 bp, Homo sapiens
  misc_feature: GYAE6OF01ER7ZM.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccgggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnn

SEQ ID NO: 263557 - DNA, 434 bp, Homo sapiens
  misc_feature: GYAE6OF01AZDH7.24.53.E09.1.454.CMB.1.raw
  modified_base (423)..(423): a, c, t, g, unknown or other
  misc_feature (423)..(423): n is a, c, g, or t
  modified_base (429)..(434): a, c, t, g, unknown or other
  misc_feature (429)..(434): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgacgcgggctggcaaggcncatagnnnnnn

SEQ ID NO: 263558 - DNA, 278 bp, Homo sapiens; identical to SEQ ID NO: 263452
  misc_feature: GYAE6OF01ERVGB.24.53.E09.1.454.CMB.1.raw
  modified_base (278)..(278): a, c, t, g, unknown or other
  misc_feature (278)..(278): n is a, c, g, or t

SEQ ID NO: 263559 - DNA, 303 bp, Homo sapiens
  misc_feature: GYAE6OF01B5DCE.24.53.E09.1.454.CMB.1.raw
  modified_base (274)..(274): a, c, t, g, unknown or other
  misc_feature (274)..(274): n is a, c, g, or t
  modified_base (280)..(303): a, c, t, g, unknown or other
  misc_feature (280)..(303): n is a, c, g, or t
tcagactactatgtcacgaccggtgctcgatttagagagagtgtgttgggtttgggggtgtggtggtctccactcccgccttgacggggctgctatcctgcctcgctggccatcactgggctccaggctgaggatgaggtgattactactgccagtcgtcgaagatgttcggcggaggactaagctgaccgtcctaggtcaagcccaaggcctgccccctggtcactctgttcccgcctctcacatacgtagtctgagcggctggacaagggcncatagnnnnnnnnnnnnnnnnnnnnnnnn

SEQ ID NO: 263560 - DNA, 432 bp, Homo sapiens
  misc_feature: GYAE6OF01DVEFG.24.53.E09.1.454.CMB.1.raw
  modified_base (426)..(432): a, c, t, g, unknown or other
  misc_feature (426)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtctaggtcagcccaaggctcgcccctggtcactctgttccccaccctcctcacatagtagtctgagcgggctggcaaggcgcatagnnnnnnn

SEQ ID NO: 263561 - DNA, 562 bp, Homo sapiens
  misc_feature: GYAE6OF01B2W9Q.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccattcaccatctccagagacaacgcccagaactcactgtatctggaaatgaccagcctgagagtcgaggacacggctatgtattactgtgcgaccatatcagcacctggagtcgcatctgaatacttccagcagttggggccagggcacccgtggtcaccgtctcctcacgcctccaccaacggcccagtccggtccttccccctggccgccctgcctccaggactccaccctccgagacgcacacggccggccccgtgggcctcggtcccgttgggtaccaaacgggaccttacccgttcccaaccgtaagttaacgttacgtcgtacggg

SEQ ID NO: 263562 - DNA, 281 bp, Homo sapiens; identical to SEQ ID NO: 263461
  misc_feature: GYAE6OF01ERD50.24.53.E09.1.454.CMB.1.raw
  modified_base (280)..(281): a, c, t, g, unknown or other
  misc_feature (280)..(281): n is a, c, g, or t

SEQ ID NO: 263563 - DNA, 280 bp, Homo sapiens
  misc_feature: GYAE6OF01EE81Q.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnn

SEQ ID NO: 263564 - DNA, 437 bp, Homo sapiens
  misc_feature: GYAE6OF01AC4ND.24.53.E09.1.454.CMB.1.raw
  modified_base (425)..(425): a, c, t, g, unknown or other
  misc_feature (425)..(425): n is a, c, g, or t
  modified_base (431)..(437): a, c, t, g, unknown or other
  misc_feature (431)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtctaggtcagcccaaggctcgccccctggtcactctcgttccccaccctcctcacatagtagtctgagcgggctggcaaggcncatagnnnnnnn

SEQ ID NO: 263565 - DNA, 437 bp, Homo sapiens
  misc_feature: GYAE6OF01AQTBI.24.53.E09.1.454.CMB.1.raw
  modified_base (424)..(424): a, c, t, g, unknown or other
  misc_feature (424)..(424): n is a, c, g, or t
  modified_base (430)..(437): a, c, t, g, unknown or other
  misc_feature (430)..(437): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggcctcgccccctggtcactctcgttccccaccctcctcacatagtgtctgacgcgggctggcaaggcncatagnnnnnnnn

SEQ ID NO: 263566 - DNA, 436 bp, Homo sapiens
  misc_feature: GYAE6OF01CYCX3.24.53.E09.1.454.CMB.1.raw
  modified_base (432)..(436): a, c, t, g, unknown or other
  misc_feature (432)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggccacctcagcctcgctggccatcactgggctccaggctgaggatgagggtgattactactgccagtcgtcgaagatggttcggcggagggactaagctgaccgtcctaggtcagcccaaggctcgcccctcgtcactctgttccccgccctctcacatacgtagtctgacgcgggctgggcaaggcgcatagnnnnn

SEQ ID NO: 263567 - DNA, 284 bp, Homo sapiens
  misc_feature: GYAE6OF01COPFJ.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagnnnn

SEQ ID NO: 263568 - DNA, 280 bp, Homo sapiens; identical to SEQ ID NO: 263491
  misc_feature: GYAE6OF01AUU4Q.24.53.E09.1.454.CMB.1.raw
  modified_base (279)..(280): a, c, t, g, unknown or other
  misc_feature (279)..(280): n is a, c, g, or t

SEQ ID NO: 263569 - DNA, 282 bp, Homo sapiens
  misc_feature: GYAE6OF01BS6OE.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagccaaggctgcccctcggtcactctgttcccaccctcctcacatagtagtctgagcgggctggcaaggcgcatagnnnnn

SEQ ID NO: 263570 - DNA, 280 bp, Homo sapiens; identical to SEQ ID NO: 263491
  misc_feature: GYAE6OF01DR33A.24.53.E09.1.454.CMB.1.raw
  modified_base (279)..(280): a, c, t, g, unknown or other
  misc_feature (279)..(280): n is a, c, g, or t

SEQ ID NO: 263571 - DNA, 298 bp, Homo sapiens
  misc_feature: GYAE6OF01BD90D.24.53.E09.1.454.CMB.1.raw
  modified_base (278)..(278): a, c, t, g, unknown or other
  misc_feature (278)..(278): n is a, c, g, or t
  modified_base (284)..(298): a, c, t, g, unknown or other
  misc_feature (284)..(298): n is a, c, g, or t
tcagactactatgtcacgaccggtgctcgatttagagagagtgtgttgggtttgggggtggtgggtggtctccactcccgccttgacggggctgctatctgcctcgctcggccatcacctgggctccaggctgaggatgagggtgattactactgccagtcgtcgaagatgttcggcggagggactaagctgaccgtcctaggtcagcccaaggctgccccctggtcactctgttcccaccctcctacatagtagtcctagagcgggctggcaaggcncatagnnnnnnnnnnnnnnn

SEQ ID NO: 263572 - DNA, 282 bp, Homo sapiens; identical to SEQ ID NO: 263490
  misc_feature: GYAE6OF01CMT1L.24.53.E09.1.454.CMB.1.raw
  modified_base (280)..(282): a, c, t, g, unknown or other
  misc_feature (280)..(282): n is a, c, g, or t

SEQ ID NO: 263573 - DNA, 280 bp, Homo sapiens
  misc_feature: GYAE6OF01CILGJ.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagn

SEQ ID NO: 263574 - DNA, 285 bp, Homo sapiens
  misc_feature: GYAE6OF01BZXF5.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttcccgccctcctcacatagtagtctgagcgggctggcaaggcgcatagnnnnnn

SEQ ID NO: 263575 - DNA, 281 bp, Homo sapiens
  misc_feature: GYAE6OF01BP80U.24.53.E09.1.454.CMB.1.raw
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnn

SEQ ID NO: 263576 - DNA, 281 bp, Homo sapiens; identical to SEQ ID NO: 263535
  misc_feature: GYAE6OF01A25P1.24.53.E09.1.454.CMB.1.raw
  modified_base (279)..(281): a, c, t, g, unknown or other
  misc_feature (279)..(281): n is a, c, g, or t

SEQ ID NO: 263577 - DNA, 290 bp, Homo sapiens
  misc_feature: GYAE6OF01D59JA.24.53.E09.1.454.CMB.1.raw
  modified_base (281)..(290): a, c, t, g, unknown or other
  misc_feature (281)..(290): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnnnnnnnnnn

SEQ ID NO: 263578 - DNA, 281 bp, Homo sapiens; identical to SEQ ID NO: 263461
  misc_feature: GYAE6OF01CBMEB.24.53.E09.1.454.CMB.1.raw
  modified_base (280)..(281): a, c, t, g, unknown or other
  misc_feature (280)..(281): n is a, c, g, or t

SEQ ID NO: 263579 - DNA, 611 bp, Homo sapiens
  misc_feature: GYAE6OF01ARG24.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccgagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagccacctggagtcgcatctgaatacttccagcaagtttggggccagggccacccgtggtccaccgtctcctcacgccctccacccgaacgggcccctacgtccggtcccttcccccgtggcccgtcccctggcccttccgacgggacgtcccgtacccgtcccggaagacggtccaaccgacggcccgggaccccgtggggcccgtcggccccgttcgggtccgaaacgggtacccttacccgtttacccactagtaacggttacgtccgtaacgggg

SEQ ID NO: 263580 - DNA, 281 bp, Homo sapiens
  misc_feature: GYAE6OF01D2CPC.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnn

SEQ ID NO: 263581 - DNA, 539 bp, Homo sapiens
  misc_feature: GYAE6OF01AUNBH.24.53.E09.1.454.CMB.1.raw
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagactactatgtcacgaccggtgctcgatttagagagagtgtgttgggggtttggggaggcttggtccagcctggggggtccctgagactctcctgtgcagccctcgtggattcccctttagtgactttttggatcgacctgggtccgccagggctccagggacggggctggagtgggtggccaatataaggcacgatggacgtagcatgtactatgtggactctgtgaagggtccgattcaccatctccagagacaacgcccagaactcactgatctggaaatgaccagcctgagagtcgaggacacggctatgtattactgtgcgaccatatcagcacctggatcgcatctagaatacttccagcagttggggccaggggccaccgtggtcaccgtctacctcacgcccctacgacggcccagtccggtctccccgtgccncctncctccaggcncacctcgagcgcacacgcgcccgtgggctgccgtggtacaacggtacctaccgttcccactactagtacgtcgtgacggg

SEQ ID NO: 263582 - DNA, 284 bp, Homo sapiens
  misc_feature: GYAE6OF01EQ6R1.24.53.E09.1.454.CMB.1.raw
  modified_base (278)..(284): a, c, t, g, unknown or other
  misc_feature (278)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnnnnn

SEQ ID NO: 263583 - DNA, 281 bp, Homo sapiens; identical to SEQ ID NO: 263535
  misc_feature: GYAE6OF01EJ7XM.24.53.E09.1.454.CMB.1.raw
  modified_base (279)..(281): a, c, t, g, unknown or other
  misc_feature (279)..(281): n is a, c, g, or t

SEQ ID NO: 263584 - DNA, 277 bp, Homo sapiens
  misc_feature: GYAE6OF01EAV72.24.53.E09.1.454.CMB.1.raw
  modified_base (277)..(277): a, c, t, g, unknown or other
  misc_feature (277)..(277): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccacctcctcacatagtagtctgagcgggctggcaaggcgcatagn

SEQ ID NO: 263585 - DNA, 431 bp, Homo sapiens
  misc_feature: GYAE6OF01BTUWL.24.53.E09.1.454.CMB.1.raw
  modified_base (426)..(431): a, c, t, g, unknown or other
  misc_feature (426)..(431): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactgggctccaggctgaggatgaggtgattactactgccagtcgtcgaagatgttcggcggaggactaagctgaccgtcaggtcagccaaggctcgcccctggcactctcgttccccgcctcctcacatacgtagtctgagcgggctggacaaggcgacatagnnnnnn

SEQ ID NO: 263586 - DNA, 450 bp, Homo sapiens
  misc_feature: GYAE6OF01BETU7.24.53.E09.1.454.CMB.1.raw
  modified_base (435)..(450): a, c, t, g, unknown or other
  misc_feature (435)..(450): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatggagggtgattactactgccagtcgtcgaagatgttcggcggagggactaagctgaccgtcctaggtcagcccaaggctcgccccctggtccactctcgttcccgccctcctcacatacgtagtcctgacgcgggctggcaaggcgacagtagnnnnnnnnnnnnnnnn

SEQ ID NO: 263587 - DNA, 282 bp, Homo sapiens
  misc_feature: GYAE6OF01COBM8.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagnn

SEQ ID NO: 263588 - DNA, 282 bp, Homo sapiens
  misc_feature: GYAE6OF01AQ3BZ.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttcccgcctcctcacatagtagtctgagcgggctggcaaggcgcatagnnnn

SEQ ID NO: 263589 - DNA, 283 bp, Homo sapiens
  misc_feature: GYAE6OF01C78YM.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatggagggtgattactactgccagtcgtcgaagatgttcggcggagggactaagctgaccgtcctaggtcagcccaaggctcgcccctcggtcactctcgttccccgccctcctcacatagtagtctgagcgggctggcaaggcgcatagnn

SEQ ID NO: 263590 - DNA, 436 bp, Homo sapiens
  misc_feature: GYAE6OF01AFRUT.24.53.E09.1.454.CMB.1.raw
  modified_base (428)..(436): a, c, t, g, unknown or other
  misc_feature (428)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagccccaaggctgccccctggtcactctgttcccgccctctcacatagtagtctgagcgggctgggcaaggcgcatagnnnnnnnnn

SEQ ID NO: 263591 - DNA, 301 bp, Homo sapiens
  misc_feature: GYAE6OF01BYB3A.24.53.E09.1.454.CMB.1.raw
  modified_base (276)..(276): a, c, t, g, unknown or other
  misc_feature (276)..(276): n is a, c, g, or t
  modified_base (282)..(301): a, c, t, g, unknown or other
  misc_feature (282)..(301): n is a, c, g, or t
tcagactactatgtcacgaccggtgctcgatttagagagagtgtgttggggtttgggggtgtggtggtctccactcccgccttgacggggctgctactctgcctcgctggccatcactggctccaggctgaggatgaggtgattactactgccagtcgtcgaagatgttcggcggagggactaagctgaccgtcctaggtcacgcccaaggctcgccccctgggtcactctcgttcccgccctctcacatagtagtctgagcgggctggcaaggcncatagnnnnnnnnnnnnnnnnnnnn

SEQ ID NO: 263592 - DNA, 351 bp, Homo sapiens
  misc_feature: GYAE6OF01CF4C0.24.53.E09.1.454.CMB.1.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (286)..(291): a, c, t, g, unknown or other
  misc_feature (286)..(291): n is a, c, g, or t
  modified_base (293)..(295): a, c, t, g, unknown or other
  misc_feature (293)..(295): n is a, c, g, or t
  modified_base (297)..(305): a, c, t, g, unknown or other
  misc_feature (297)..(305): n is a, c, g, or t
  modified_base (307)..(351): a, c, t, g, unknown or other
  misc_feature (307)..(351): n is a, c, g, or t
tcagactactatgtcacgaccggtgctcgatttagagagagtgtgtttggggtttgggggtgtggtggtctcctactcccgccttgacggggctgctatctgcctcgctggccatcactgggctccgaggctgaggatgagggtgattactaactgccagtcgtcgaagatgttcggcgaggactaagctgaccgtctaggtcagcccaaggctgccccctggtcactctgttccccacctccgtcacatagtagtctgagcgggctggccaaaggcanatagnannnnnncnnncnnnnnnnnntnnnnnnnnnnnnnnnnnnnnnnnnnnnnnnnnnnnnnnnnnnnnn

SEQ ID NO: 263593 - DNA, 279 bp, Homo sapiens
  misc_feature: GYAE6OF01DYXDV.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagn

SEQ ID NO: 263594 - DNA, 280 bp, Homo sapiens; identical to SEQ ID NO: 263547
  misc_feature: GYAE6OF01B3UNK.24.53.E09.1.454.CMB.1.raw
  modified_base (279)..(280): a, c, t, g, unknown or other
  misc_feature (279)..(280): n is a, c, g, or t

SEQ ID NO: 263595 - DNA, 440 bp, Homo sapiens
  misc_feature: GYAE6OF01AG0BL.24.53.E09.1.454.CMB.1.raw
  modified_base (431)..(440): a, c, t, g, unknown or other
  misc_feature (431)..(440): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaagggctcgccccctggtcactctcgttccccaccctcctcacatagtagtctgagcgggctgggcaaggcgcatagnnnnnnnnnn

SEQ ID NO: 263596 - DNA, 282 bp, Homo sapiens; identical to SEQ ID NO: 263509
  misc_feature: GYAE6OF01B2VMC.24.53.E09.1.454.CMB.1.raw
  modified_base (280)..(282): a, c, t, g, unknown or other
  misc_feature (280)..(282): n is a, c, g, or t

SEQ ID NO: 263597 - DNA, 282 bp, Homo sapiens
  misc_feature: GYAE6OF01APJVU.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnn

SEQ ID NO: 263598 - DNA, 310 bp, Homo sapiens
  misc_feature: GYAE6OF01CRU3E.24.53.E09.1.454.CMB.1.raw
  modified_base (283)..(310): a, c, t, g, unknown or other
  misc_feature (283)..(310): n is a, c, g, or t
tcagactactatgtcacgaccggtgctcgatttagagagagtgtgttggggtttggggggtgtggtggtctccactcccgccttgacggggctgctatctgcctcgctggccatcactgggctccaggcttaggatgagggtgattactactgccagtcgtcgaagatgttcggcggagggactaagctgaccgtcctaggtcagcccaaggctgccccctggtcactctcgttcccaccctcctcactatagtagtctgagcgggctggcaaggcgcatagnnnnnnnnnnnnnnnnnnnnnnnnnnnn

SEQ ID NO: 263599 - DNA, 444 bp, Homo sapiens
  misc_feature: GYAE6OF01BWQ71.24.53.E09.1.454.CMB.1.raw
  modified_base (293)..(293): a, c, t, g, unknown or other
  misc_feature (293)..(293): n is a, c, g, or t
  modified_base (437)..(444): a, c, t, g, unknown or other
  misc_feature (437)..(444): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacacgcccccaaactcctcatttatcgtaaacaacaatccggccctcgtggggtccctgaccgattctccgcctccaagtctggcacctcagcctcgctggccatcactgggctcaggctgaggatggagggtnattactactgccagtcgtacgaagatggttaggcggaagggactaagctgaccgtcaggtcagcccaaggctcgcccctggtcactctcgttccccgctcatcacatagtagtctagacgcgggctaggcaagggcgacatagnnnnnnnn

SEQ ID NO: 263600 - DNA, 431 bp, Homo sapiens
  misc_feature: GYAE6OF01D62ZO.24.53.E09.1.454.CMB.1.raw
  modified_base (290)..(290): a, c, t, g, unknown or other
  misc_feature (290)..(290): n is a, c, g, or t
  modified_base (423)..(423): a, c, t, g, unknown or other
  misc_feature (423)..(423): n is a, c, g, or t
  modified_base (428)..(431): a, c, t, g, unknown or other
  misc_feature (428)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatgtcggcggagggactaagctgaccgtctaggtcagcccaaggctcgcccctggtcactctcgttccccacctcctcacatagtagtctgagcgggctggacaaggcgnatagnnnn

SEQ ID NO: 263601 - DNA, 431 bp, Homo sapiens
  misc_feature: GYAE6OF01EAED3.24.53.E09.1.454.CMB.1.raw
  modified_base (427)..(431): a, c, t, g, unknown or other
  misc_feature (427)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtctaggtcagcccaaggctgccccctcggtcactctcgttcccgccctcctcacatagtagtctgagcgggctgggcaaggcgcatagnnnnn

SEQ ID NO: 263602 - DNA, 438 bp, Homo sapiens
  misc_feature: GYAE6OF01B1JG6.24.53.E09.1.454.CMB.1.raw
  modified_base (429)..(438): a, c, t, g, unknown or other
  misc_feature (429)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtctaggtcagcccaaggctcgcccctggtcactctcgttccccacctcctcacatagtagtctgacgcgggctggcaaggcgcatagnnnnnnnnnn

SEQ ID NO: 263603 - DNA, 282 bp, Homo sapiens; identical to SEQ ID NO: 263597
  misc_feature: GYAE6OF01BN0IJ.24.53.E09.1.454.CMB.1.raw
  modified_base (279)..(282): a, c, t, g, unknown or other
  misc_feature (279)..(282): n is a, c, g, or t

SEQ ID NO: 263604 - DNA, 431 bp, Homo sapiens
  misc_feature: GYAE6OF01EFK34.24.53.E09.1.454.CMB.1.raw
  modified_base (428)..(431): a, c, t, g, unknown or other
  misc_feature (428)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctcgttcccaccctcctcacatagtagtctgagcgggctggcaaggcgcatagnnnn

SEQ ID NO: 263605 - DNA, 320 bp, Homo sapiens
  misc_feature: GYAE6OF01D9I3D.24.53.E09.1.454.CMB.1.raw
  modified_base (279)..(279): a, c, t, g, unknown or other
  misc_feature (279)..(279): n is a, c, g, or t
  modified_base (285)..(320): a, c, t, g, unknown or other
  misc_feature (285)..(320): n is a, c, g, or t
tcagactactatgtcacgaccggtgctcgatttagagagagtgtgttgggtttggggggtgtggtggtctccactccggccttgacggggctgctatctgcctcgctggccatctactgggtctccaggctgaggatgagggtgattactaacgtgccagtcgtcgaagatgttcggcggagggactaagctgaccgtcctaggtcagcccaaggctgcccctcggtcactctgttcccacctcctcacataagtagtctgagcgggctggacaaggcncatagnnnnnnnnnnnnnnnnnnnnnnnnnnnnnnnnnnnn

SEQ ID NO: 263606 - DNA, 279 bp, Homo sapiens
  misc_feature: GYAE6OF01BG7BX.24.53.E09.1.454.CMB.1.raw
  modified_base (278)..(279): a, c, t, g, unknown or other
  misc_feature (278)..(279): n is a, c, g, or t
tcagactactatgtcacgaccggtgctcgatttagagagagtgtgttgggtttggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctctcacatagtagtctgagcgggctggcaaggcgcatagnn

SEQ ID NO: 263607 - DNA, 279 bp, Homo sapiens; identical to SEQ ID NO: 263593
  misc_feature: GYAE6OF01CZ79E.24.53.E09.1.454.CMB.1.raw
  modified_base (279)..(279): a, c, t, g, unknown or other
  misc_feature (279)..(279): n is a, c, g, or t

SEQ ID NO: 263608 - DNA, 434 bp, Homo sapiens
  misc_feature: GYAE6OF01DGO58.24.53.E09.1.454.CMB.1.raw
  modified_base (424)..(424): a, c, t, g, unknown or other
  misc_feature (424)..(424): n is a, c, g, or t
  modified_base (430)..(434): a, c, t, g, unknown or other
  misc_feature (430)..(434): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctcaggctgaggatgagggtgattactactgccagtcgtcgaagatgttcgggcggagggactaagctgaccgtcctaggtcagcccaaggctcgccccctggtcactctcgttccccaccctcctcacatagtagtctgagcgggctggcaaggcncatagnnnnn

SEQ ID NO: 263609 - DNA, 280 bp, Homo sapiens
  misc_feature: GYAE6OF01AVB3L.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnn

SEQ ID NO: 263610 - DNA, 479 bp, Homo sapiens
  misc_feature: GYAE6OF01CC23L.24.53.E09.1.454.CMB.1.raw
  modified_base (449)..(479): a, c, t, g, unknown or other
  misc_feature (449)..(479): n is a, c, g, or t
tcagactactatgtcacgaccggtgctcgatttagagagagtgtgttggggtttgggggctgttttggaagctgcttgtacagagggtcaccatctcctgcactgggagcaacatcggcgcaggttttgatgtccactggtacaagcagcttaccaaaaaacagcccccaaaactcctctatttatcgtaaacaaacaaagtcggccctctcggggtccctgaccgattctccgcctccaagtctggcacctcagcctcgctggccaatcactgggctccaggctgaggatgaggtgattactactgccagtcgtcgaagatggttcggcggaagggactaagctagaccgtcctaaggtcaagccgaaaggctcgccccctggtccactctcgttccccacctcctcacatacgtagtctgagcgggctggactaaggcgacagtagnnnnnnnnnnnnnnnnnnnnnnnnnnnnnnn

SEQ ID NO: 263611 - DNA, 496 bp, Homo sapiens
  misc_feature: GYAE6OF01B2173.24.53.E09.1.454.CMB.1.raw
  modified_base (304)..(305): a, c, t, g, unknown or other
  misc_feature (304)..(305): n is a, c, g, or t
  modified_base (308)..(311): a, c, t, g, unknown or other
  misc_feature (308)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (383)..(384): a, c, t, g, unknown or other
  misc_feature (383)..(384): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagactactatgtcacgaccggtgctcgatttagagagagtgtgttggggtttgggggggtgtggtggtctccgacctcccgcttgacggggctgctatcgtcgcctcgctggcctagtcacctgggctcctaggctgacggagtgagggtgattactactgccagtcgtcgaagactgttcgcggaggactaagctcgacgtcctaggtcgagcccaaggctcgccccctggtcactctcggttcccgacctcctacactatagtacgtcttagagcgggctggcaaggccgacgaatacgnncannnncntnatacatacanacgtcggcactcgcgtctgtgctgctgtggngagatntcnctcncnctctctatatcnncagagagtatntatactatctntcatatatatgtgtcgtgtacgacgtacgtacgtacgtaacgtactagtgtcgtcgtgtactactatctctctctctctctctctctctc

SEQ ID NO: 263612 - DNA, 443 bp, Homo sapiens
  misc_feature: GYAE6OF01DQQ79.24.53.E09.1.454.CMB.1.raw
  modified_base (434)..(443): a, c, t, g, unknown or other
  misc_feature (434)..(443): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggcctcgccccctcggtcactctcgttccccgcctcctcacatagtacgtctgagcgggctcggacacggcgcactagnnnnnnnnnn

SEQ ID NO: 263613 - DNA, 280 bp, Homo sapiens; identical to SEQ ID NO: 263573
  misc_feature: GYAE6OF01B1SWC.24.53.E09.1.454.CMB.1.raw
  modified_base (280)..(280): a, c, t, g, unknown or other
  misc_feature (280)..(280): n is a, c, g, or t

SEQ ID NO: 263614 - DNA, 440 bp, Homo sapiens
  misc_feature: GYAE6OF01B41RU.24.53.E09.1.454.CMB.1.raw
  modified_base (431)..(440): a, c, t, g, unknown or other
  misc_feature (431)..(440): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactccctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgtttcccaccctcctcactatagtacgtctgacgcgggctggcaaggcgcatagnnnnnnnnnn

SEQ ID NO: 263615 - DNA, 285 bp, Homo sapiens
  misc_feature: GYAE6OF01D964C.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnnnn

SEQ ID NO: 263616 - DNA, 283 bp, Homo sapiens
  misc_feature: GYAE6OF01EDS7Q.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgaggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnn

SEQ ID NO: 263617 - DNA, 437 bp, Homo sapiens
  misc_feature: GYAE6OF01EJR7Z.24.53.E09.1.454.CMB.1.raw
  modified_base (424)..(424): a, c, t, g, unknown or other
  misc_feature (424)..(424): n is a, c, g, or t
  modified_base (429)..(437): a, c, t, g, unknown or other
  misc_feature (429)..(437): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgtcggcggagggactaagctgaccgtctaggtcagcccaaggcctcgcccctggtcactctcgttccccaccctcctcacatacgtagtctgacgcgggctggcaaggccnatagnnnnnnnnn

SEQ ID NO: 263618 - DNA, 545 bp, Homo sapiens
  misc_feature: GYAE6OF01BZ4GP.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaaatgaccagcctgagagtcgaggacacggctatgtattactgtgcgaccatatcagcacctggagtcgcatctgaatacttcagcattggggccagggcaccctggtcaccgtctcctcacgcctccaccaacgggcccatccggtccttccccctggccgccctgcctccgaggacgccacccgtccgagacgcacacggccggcccgtgggcctcggccctgggtccaacgggaccttaccgttcccacattacgtagtcgtacggg

SEQ ID NO: 263619 - DNA, 566 bp, Homo sapiens
  misc_feature: GYAE6OF01CN0IM.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtatactgtgcgaccatatcagccactggagtcgcatctagaactacttccagctaagttcggggccaggggccacccgtggtaccacccgtcctcctcacgccctaccaacccgaacgggccccagttcccggttcccttcccccgtcggcccgccctgcctccgaggcgccaccgtccgagcgcacagccggccctgggcctcggccttgggccaaacggtaccttaccgttcccaacacttaagtgtcctaggg

SEQ ID NO: 263620 - DNA, 283 bp, Homo sapiens
  misc_feature: GYAE6OF01DD8LY.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctcgccccctcggtcactttgttccccgcctcctcacatagtagtctgagcgggctggcaaggcgcatagnnnnn

SEQ ID NO: 263621 - DNA, 432 bp, Homo sapiens
  misc_feature: GYAE6OF01DH16E.24.53.E09.1.454.CMB.1.raw
  modified_base (161)..(161): a, c, t, g, unknown or other
  misc_feature (161)..(161): n is a, c, g, or t
  modified_base (317)..(317): a, c, t, g, unknown or other
  misc_feature (317)..(317): n is a, c, g, or t
  modified_base (423)..(432): a, c, t, g, unknown or other
  misc_feature (423)..(432): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgctccaagtctggcacctcagcctcgctggccatcactgggctccaggctgaggatgagggtgattactactgccagtcgtcgaagatgtcggnggagggactaagctgaccgtctaggtcagcccaaggctgcccctggtcactctgttccccgccctctcactatagtagtctgacgcgggctggcaaggcgcatagnnnnnnnnnn

SEQ ID NO: 263622 - DNA, 438 bp, Homo sapiens
  misc_feature: GYAE6OF01ECFWM.24.53.E09.1.454.CMB.1.raw
  modified_base (161)..(161): a, c, t, g, unknown or other
  misc_feature (161)..(161): n is a, c, g, or t
  modified_base (289)..(289): a, c, t, g, unknown or other
  misc_feature (289)..(289): n is a, c, g, or t
  modified_base (422)..(422): a, c, t, g, unknown or other
  misc_feature (422)..(422): n is a, c, g, or t
  modified_base (428)..(438): a, c, t, g, unknown or other
  misc_feature (428)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatggttcggcggaggactaagctgaccgtctaggtcaggcccaaggctcgccccctggtcactctcgttccccgcctcctcacatagtagtctgagcggctggcaaggcncatagnnnnnnnnnnn

SEQ ID NO: 263623 - DNA, 511 bp, Homo sapiens
  misc_feature: GYAE6OF01DDA6H.24.53.E09.1.454.CMB.1.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (489)..(511): a, c, t, g, unknown or other
  misc_feature (489)..(511): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaaactcctcatttatcgtaacaacaatcggccctctggggtccctgaccgattctccgcctccaagtctggcacctcagcctcgctggccatcactgggctccaggctgaggatgagggtnattacactgccagtcgtcgaaagntggtcggcggaggactagctcgaccgtcgtaggtcacgaccgaaggtcctcccgcccccgtggtcctaccgttccgttccggtttcccccgccccttccctccaaccgtagttaacggttacgtcgtacggacgggccggggtcgtacgggacgtaagggccgacgtaacgtagcnnnnnnnnnnnnnnnnnnnnnnn

SEQ ID NO: 263624 - DNA, 284 bp, Homo sapiens
  misc_feature: GYAE6OF01AU2C7.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnnn

SEQ ID NO: 263625 - DNA, 519 bp, Homo sapiens
  misc_feature: GYAE6OF01EU7IO.24.53.E09.1.454.CMB.1.raw
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgacatatcagcacctggatcgcatctgaatacttccagcagttggggccagggcacccgtggtccaccgtctcctcagcctccacaacggcccatccggtccttccccctggccgccctgcctccgaggacgccacctccgagcgcacagccggcccngggctcgccncggtcaacggctacttccacatagtgtctgg

SEQ ID NO: 263626 - DNA, 575 bp, Homo sapiens
  misc_feature: GYAE6OF01D5VQ5.24.53.E09.1.454.CMB.1.raw
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
  modified_base (305)..(305): a, c, t, g, unknown or other
  misc_feature (305)..(305): n is a, c, g, or t
  modified_base (551)..(575): a, c, t, g, unknown or other
  misc_feature (551)..(575): n is a, c, g, or t
tcagactactatgtcacgaccggtgctcgatttagagagagtgtgttgggtttggggctgttttggaagctgcttgtaccagagggtcaccatctcctgcactgggagcaacatcggcgctaggttttgatgtccactggtacaagcagcttaccaaaaacncgaccccccaaactcctcattttanaccgtaaacaacaatccggccctcgtcggggtcccctgaccgtattcctcccgcctccaagtctggccacctcacgcctcgctggccatcacgtggctccgagctgaggatgagggtnacttactacgtgcctaggttccggtacgaagtagttcggttccgggacgggaagggtaaccttaaggccgttcggaccccgtccgtaagggtccaacggaccccgaagggtccctaccggcccccctgggtccaccgttccgttcccgttccccccgccccttacctacctaacctaacgttacgtaacggttccgtagggaccggtccggggtcgtacgggaccgaacgggccgactaagtaggnnnnnnnnnnnnnnnnnnnnnnnnn

SEQ ID NO: 263627 - DNA, 290 bp, Homo sapiens
  misc_feature: GYAE6OF01C8HVK.24.53.E09.1.454.CMB.1.raw
  modified_base (280)..(290): a, c, t, g, unknown or other
  misc_feature (280)..(290): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctgttcccaccctcctcacatagtagtctgagcgggctggcaaggcgcatagnnnnnnnnnnn

SEQ ID NO: 263628 - DNA, 286 bp, Homo sapiens
  misc_feature: GYAE6OF01C21KG.24.53.E09.1.454.CMB.1.raw
  modified_base (279)..(286): a, c, t, g, unknown or other
  misc_feature (279)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnnnnn

SEQ ID NO: 263629 - DNA, 436 bp, Homo sapiens
  misc_feature: GYAE6OF01BF8MW.24.53.E09.1.454.CMB.1.raw
  modified_base (162)..(162): a, c, t, g, unknown or other
  misc_feature (162)..(162): n is a, c, g, or t
  modified_base (425)..(425): a, c, t, g, unknown or other
  misc_feature (425)..(425): n is a, c, g, or t
  modified_base (430)..(436): a, c, t, g, unknown or other
  misc_feature (430)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaatcctcatttatcgtaaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggcagcccaaggcctgccccctggtcactctcgttcccaccctctcacatagtacgtctgaggcgggctgggacaaggcncatgnnnnnnn

SEQ ID NO: 263630 - DNA, 428 bp, Homo sapiens
  misc_feature: GYAE6OF01EJ12U.24.53.E09.1.454.CMB.1.raw
  modified_base (417)..(417): a, c, t, g, unknown or other
  misc_feature (417)..(417): n is a, c, g, or t
  modified_base (422)..(428): a, c, t, g, unknown or other
  misc_feature (422)..(428): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggaggactaagctgaccgtctaggtcagcccaaggctcgcccctggtcactctcgtcccacctcctcacatagtagtctgagcgggctggcaaggcncatgnnnnnnn

SEQ ID NO: 263631 - DNA, 281 bp, Homo sapiens; identical to SEQ ID NO: 263461
  misc_feature: GYAE6OF01CNODH.24.53.E09.1.454.CMB.1.raw
  modified_base (280)..(281): a, c, t, g, unknown or other
  misc_feature (280)..(281): n is a, c, g, or t

SEQ ID NO: 263632 - DNA, 280 bp, Homo sapiens; identical to SEQ ID NO: 263488
  misc_feature: GYAE6OF01B3D5E.24.53.E09.1.454.CMB.1.raw
  modified_base (280)..(280): a, c, t, g, unknown or other
  misc_feature (280)..(280): n is a, c, g, or t

SEQ ID NO: 263633 - DNA, 280 bp, Homo sapiens; identical to SEQ ID NO: 263547
  misc_feature: GYAE6OF01CJY3H.24.53.E09.1.454.CMB.1.raw
  modified_base (279)..(280): a, c, t, g, unknown or other
  misc_feature (279)..(280): n is a, c, g, or t

SEQ ID NO: 263634 - DNA, 560 bp, Homo sapiens
  misc_feature: GYAE6OF01D5WIV.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccgagggacggggctggagtgggtggccaatataaggcacgatggacgtagcatgtactatgtggactctgtgaagggccattcaccatctccagagacaacgcccagaactcactgtatctggaaatgaccagcctgagagtcgaggacacggctatgtattactgtgcgaccatatcagcacctggagtcgcatctgaatacttccagcagttggggccagggcaccctggtccaccgtctcctcacgcctccaccaacgggcccatccggtccttccccctggccgtccctgcctcccgaggcgccaccctccgagacgcacgacgccggccccgtgggcctcggcccgtgggtccaacgggtacccttaaccgttcccaacgtaattacggttagtcgtacggg

SEQ ID NO: 263635 - DNA, 379 bp, Homo sapiens
  misc_feature: GYAE6OF01A5E1Y.24.53.E09.1.454.CMB.1.raw
  modified_base (375)..(379): a, c, t, g, unknown or other
  misc_feature (375)..(379): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnn

SEQ ID NO: 263636 - DNA, 281 bp, Homo sapiens
  misc_feature: GYAE6OF01DKG8Y.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctcgttcccaccctcctcacatagtagtctgagcgggctggcaaggcgcatagnnn

SEQ ID NO: 263637 - DNA, 300 bp, Homo sapiens
  misc_feature: GYAE6OF01DEQGD.24.53.E09.1.454.CMB.1.raw
  modified_base (279)..(300): a, c, t, g, unknown or other
  misc_feature (279)..(300): n is a, c, g, or t
tcagactactatgtcacgaccggtgctcgatttagagagagtgtgttgggtttgggggtgtggtgggtctccactccgccttgacggggctgctatctgcctcgctggccatcactgggctccaggctgaggatgagggtgattactactgccagtcgtcgaagatgttcggcggaggactaagctgaccgtcctaggtcagcccaaggctgccccctggtcactctcgttcccaccctcctcacatagtagtctgagcgggctggcaaggcgcatagnnnnnnnnnnnnnnnnnnnnnn

SEQ ID NO: 263638 - DNA, 281 bp, Homo sapiens; identical to SEQ ID NO: 263485
  misc_feature: GYAE6OF01DYJCV.24.53.E09.1.454.CMB.1.raw
  modified_base (280)..(281): a, c, t, g, unknown or other
  misc_feature (280)..(281): n is a, c, g, or t

SEQ ID NO: 263639 - DNA, 543 bp, Homo sapiens
  misc_feature: GYAE6OF01A7G6M.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatcttccagcattggggccagggcaccctgtcaccgtctcctcacgcctccaccaacggccccagtccggtccttccccctggccgccctgcctcccgaggcgccaccctccgagacgccacgacggccgcccgtgggcctcgcccgtcggtccaaacggcctaaccgttccaaccattacgtcgtctacggg

SEQ ID NO: 263640 - DNA, 282 bp, Homo sapiens
  misc_feature: GYAE6OF01A5YAC.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnn

SEQ ID NO: 263641 - DNA, 431 bp, Homo sapiens
  misc_feature: GYAE6OF01A1XQE.24.53.E09.1.454.CMB.1.raw
  modified_base (427)..(431): a, c, t, g, unknown or other
  misc_feature (427)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatgtagtctgagcgggctggcaaggcgcatagnnnnn

SEQ ID NO: 263642 - DNA, 287 bp, Homo sapiens
  misc_feature: GYAE6OF01DT5LA.24.53.E09.1.454.CMB.1.raw
  modified_base (281)..(287): a, c, t, g, unknown or other
  misc_feature (281)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnnnnnn

SEQ ID NO: 263643 - DNA, 453 bp, Homo sapiens
  misc_feature: GYAE6OF01DGSJM.24.53.E09.1.454.CMB.1.raw
  modified_base (162)..(162): a, c, t, g, unknown or other
  misc_feature (162)..(162): n is a, c, g, or t
  modified_base (445)..(453): a, c, t, g, unknown or other
  misc_feature (445)..(453): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgccccccaaactcctcattttatcgtaacaacaatcggccctcgtggggtccctgaccgattcctccgcctccaagtcctggcacctcagcctcgctggcccatcactgggctccaggctgaggatgagggtgattactactgccagtcgtcgaagagtggttcggcggagggactaaggctgaccgtcctaggtcacgcccaaggctcgccccctggtccactctcgttccccgccctcctcacatacgtagtctgagcgggctgggacaaggcgcatagnnnnnnnnn

SEQ ID NO: 263644 - DNA, 501 bp, Homo sapiens
  misc_feature: GYAE6OF01CRLBS.24.53.E09.1.454.CMB.1.raw
  modified_base (325)..(325): a, c, t, g, unknown or other
  misc_feature (325)..(325): n is a, c, g, or t
  modified_base (487)..(501): a, c, t, g, unknown or other
  misc_feature (487)..(501): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttaccaaaaacagccccccaaaactcctcatttatcgtaacaacaatccggccctcgtggggtcccctgaccgtattcctccgcctccaagtctggcacctcagcctcgctggccatcactggctccaggctgaggatggagggtgattactactggcccagtcgtacgaaagngttggttcggcgggaagggtactaaggctcggacccgtcgtaggtcacgcccaagggcctcgccccccgtggtccacttccgtcgttacccccaccttccctcactacgttacgtagttccgtggacggccgggtctacgggacgaaggccgactaagtagnnnnnnnnnnnnnnn

SEQ ID NO: 263645 - DNA, 288 bp, Homo sapiens
  misc_feature: GYAE6OF01B9ZLI.24.53.E09.1.454.CMB.1.raw
  modified_base (281)..(288): a, c, t, g, unknown or other
  misc_feature (281)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggccaaggcgcatagnnnnnnnn

SEQ ID NO: 263646 - DNA, 281 bp, Homo sapiens; identical to SEQ ID NO: 263485
  misc_feature: GYAE6OF01EBWAB.24.53.E09.1.454.CMB.1.raw
  modified_base (280)..(281): a, c, t, g, unknown or other
  misc_feature (280)..(281): n is a, c, g, or t

SEQ ID NO: 263647 - DNA, 281 bp, Homo sapiens; identical to SEQ ID NO: 263485
  misc_feature: GYAE6OF01EC7C2.24.53.E09.1.454.CMB.1.raw
  modified_base (280)..(281): a, c, t, g, unknown or other
  misc_feature (280)..(281): n is a, c, g, or t

SEQ ID NO: 263648 - DNA, 305 bp, Homo sapiens
  misc_feature: GYAE6OF01D6MLF.24.53.E09.1.454.CMB.1.raw
  modified_base (288)..(305): a, c, t, g, unknown or other
  misc_feature (288)..(305): n is a, c, g, or t
tcagactactatgtcacgaccggtgctcgatttagagagagtgtgttgggttgggggtgtggtggtctccactccgccttgacgggctgactatctgcctcgctggccatcactgggctccaggctgaggatgacgggtgattacgtacctgtccagtcgtcggaagatgttcggcggagggactaagctgaccgtcctaggtcacgcccaaggcctcgccccctcggtccattctcgttcccaccctcctcacatagtagtctgagcgggctggcaaggcgcatagnnnnnnnnnnnnnnnnnn

SEQ ID NO: 263649 - DNA, 282 bp, Homo sapiens; identical to SEQ ID NO: 263490
  misc_feature: GYAE6OF01AOZHA.24.53.E09.1.454.CMB.1.raw
  modified_base (280)..(282): a, c, t, g, unknown or other
  misc_feature (280)..(282): n is a, c, g, or t

SEQ ID NO: 263650 - DNA, 281 bp, Homo sapiens
  misc_feature: GYAE6OF01CL9E2.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccacctcctcacatagtagtctgagcgggctggcaaggcgcatagnnn

SEQ ID NO: 263651 - DNA, 352 bp, Homo sapiens
  misc_feature: GYAE6OF01CWA34.24.53.E09.1.454.CMB.1.raw
  modified_base (293)..(294): a, c, t, g, unknown or other
  misc_feature (293)..(294): n is a, c, g, or t
  modified_base (296)..(352): a, c, t, g, unknown or other
  misc_feature (296)..(352): n is a, c, g, or t
tcagactactatgtcacgaccggtgctcgatttagagagagtgtgttgggtttggggggtgtggtggtctcctactcccgccttgacggggcttgctatctgcctcggctggccatcactgggctccgaggctgaggatggaggggtgatttactactgccagtcgtcgaagatgttcggcggagggactaagcctggaccgtcctacggtccagcccaaggcctgccccctggtcactctgttcccaccctcctcacatagtagtctgagcgggtctggcaaggcgcatagnngnnnnnnnnnnnnnnnnnnnnnnnnnnnnnnnnnnnnnnnnnnnnnnnnnnnnnnnnn

SEQ ID NO: 263652 - DNA, 435 bp, Homo sapiens
  misc_feature: GYAE6OF01DLWCY.24.53.E09.1.454.CMB.1.raw
  modified_base (160)..(160): a, c, t, g, unknown or other
  misc_feature (160)..(160): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagactactatgtcacgaccggtgctcgatttagagagagtgtgttgagtttgggggctgttttggagctgcttgtaccagagggtcaccatctcctgcactgggagcaacatcggcgcaggttttgatgtccactggtacaagcagcttccaaaaacngcccccaaactcctcatttatcgtaacaacaatccggcctctggggtccctgaccgattctccgcctccaagtctggcacctcagcctcgctggccatcactgggctccaggctgaggatgagggtgattactactgccagtcgtcgaagntggttcggcggagggactaagctgaccgtctaggtcagcccaaggctcgccccctggcactctcgttccccaccctccncacatagtagtctgacgcgggctggcaaggcncatagnnnnnnnn

SEQ ID NO: 263653 - DNA, 444 bp, Homo sapiens
  misc_feature: GYAE6OF01CU9RF.24.53.E09.1.454.CMB.1.raw
  modified_base (393)..(393): a, c, t, g, unknown or other
  misc_feature (393)..(393): n is a, c, g, or t
  modified_base (432)..(444): a, c, t, g, unknown or other
  misc_feature (432)..(444): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgaccccccaaactcctcatttatcgtaacaacaatcggccctctggggtccctgaccgattcctccgcctccaagtctggccacctcagcctcgctggccatcactgggctccaggctgaggatggagggtgattactactgccagtcgtcgaagatggttcggcggagggactaagctgaccgtctaggtcagcccaagctcgcccctgtcactctcgtcccacctcncacatagtgtctgcgcgggctcggcgaaggcacagtagnnnnnnnnnnnnn

SEQ ID NO: 263654 - DNA, 436 bp, Homo sapiens
  misc_feature: GYAE6OF01BMC8W.24.53.E09.1.454.CMB.1.raw
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
  modified_base (424)..(436): a, c, t, g, unknown or other
  misc_feature (424)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactgggctccaggctgaggatgagggtnattacactgccagtcgtcgaagatgtcggcggaggactaagctgaccgtctaggtcacgccgagctccgcccgtgtcactctcgtcccncctcncactatagtgtctgcggcggtcgtggacgaggcanagtgnnnnnnnnnnnnn

SEQ ID NO: 263655 - DNA, 430 bp, Homo sapiens
  misc_feature: GYAE6OF01B0OWE.24.53.E09.1.454.CMB.1.raw
  modified_base (427)..(430): a, c, t, g, unknown or other
  misc_feature (427)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnn

SEQ ID NO: 263656 - DNA, 440 bp, Homo sapiens
  misc_feature: GYAE6OF01AHSX1.24.53.E09.1.454.CMB.1.raw
  modified_base (430)..(430): a, c, t, g, unknown or other
  misc_feature (430)..(430): n is a, c, g, or t
  modified_base (435)..(440): a, c, t, g, unknown or other
  misc_feature (435)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattcttcgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacattacgtagtctgacggcgggctgggcaagggcncatgnnnnnn

SEQ ID NO: 263657 - DNA, 448 bp, Homo sapiens
  misc_feature: GYAE6OF01BG6NB.24.53.E09.1.454.CMB.1.raw
  modified_base (160)..(160): a, c, t, g, unknown or other
  misc_feature (160)..(160): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
  modified_base (434)..(448): a, c, t, g, unknown or other
  misc_feature (434)..(448): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattcctccgcctccaagtctggcacctcagcctcgctggccatcactgggctccaggctgaggatgagggtnattactactgccagtcgtcgaagatgtcggnggaggactaagctgaccgtcctaggtcagccccaaggcctcgccccctggtccactctcgttccccaccctcctcacatagtagtcctgacgcggctggcaaggccganagtagnnnnnnnnnnnnnnn

SEQ ID NO: 263658 - DNA, 282 bp, Homo sapiens; identical to SEQ ID NO: 263587
  misc_feature: GYAE6OF01D5A9T.24.53.E09.1.454.CMB.1.raw
  modified_base (281)..(282): a, c, t, g, unknown or other
  misc_feature (281)..(282): n is a, c, g, or t

SEQ ID NO: 263659 - DNA, 433 bp, Homo sapiens
  misc_feature: GYAE6OF01D2UCY.24.53.E09.1.454.CMB.1.raw
  modified_base (423)..(423): a, c, t, g, unknown or other
  misc_feature (423)..(423): n is a, c, g, or t
  modified_base (428)..(433): a, c, t, g, unknown or other
  misc_feature (428)..(433): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggcctcgccccctcggtcactctcgttccccaccctcctcacatagtagtctgagcgggctggcaaggcncatgnnnnnn

SEQ ID NO: 263660 - DNA, 438 bp, Homo sapiens
  misc_feature: GYAE6OF01D7E14.24.53.E09.1.454.CMB.1.raw
  modified_base (428)..(438): a, c, t, g, unknown or other
  misc_feature (428)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtctaggtcagcccaaggctcgcccctggtcactctcgtcccaccctctcacatagtagtctgagcgggctggacaaggcgcatagnnnnnnnnnnn

SEQ ID NO: 263661 - DNA, 435 bp, Homo sapiens
  misc_feature: GYAE6OF01BGOO9.24.53.E09.1.454.CMB.1.raw
  modified_base (426)..(435): a, c, t, g, unknown or other
  misc_feature (426)..(435): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnnnnnnn

SEQ ID NO: 263662 - DNA, 438 bp, Homo sapiens
  misc_feature: GYAE6OF01ARJYA.24.53.E09.1.454.CMB.1.raw
  modified_base (427)..(438): a, c, t, g, unknown or other
  misc_feature (427)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctcgttccccaccctcctcacatagtagtctgagcgggctggcaaggcgcatagnnnnnnnnnnnn

SEQ ID NO: 263663 - DNA, 441 bp, Homo sapiens
  misc_feature: GYAE6OF01AV3ZT.24.53.E09.1.454.CMB.1.raw
  modified_base (431)..(441): a, c, t, g, unknown or other
  misc_feature (431)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatggaggtgattactactgccagtcgtcgaagatgttcggcggagggactaagctgaccgtcctaggtcagcccaaggctcgcccctcggtcactctcgttccccgccctcctcacatacgtgtctgagcgggctggcaaggcgcatagnnnnnnnnnnn

SEQ ID NO: 263664 - DNA, 461 bp, Homo sapiens
  misc_feature: GYAE6OF01C6OQD.24.53.E09.1.454.CMB.1.raw
  modified_base (452)..(461): a, c, t, g, unknown or other
  misc_feature (452)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactcctcatttatcgtaaacaacaatcggccctcgtggggtccctgaccgattcctccgcctccaagtctggccacctcagcctcgctggccatccactgggcctccaggctgaggatggagggtgattactactgccagtcgtacgaagatggttcggcggagggactaagctgaccgtccgtaggtcacgcccaaggcctcgcccctggtcactctcgtccccacctcctcactatagtactctaggacgcgggtctggacgaacggcgacagtagcnnnnnnnnnn

SEQ ID NO: 263665 - DNA, 284 bp, Homo sapiens
  misc_feature: GYAE6OF01A6PQC.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttcccaccctcctcacatagtagtctgagcgggctggcaaggcgcatagnnnn

SEQ ID NO: 263666 - DNA, 281 bp, Homo sapiens; identical to SEQ ID NO: 263461
  misc_feature: GYAE6OF01EPR9A.24.53.E09.1.454.CMB.1.raw
  modified_base (280)..(281): a, c, t, g, unknown or other
  misc_feature (280)..(281): n is a, c, g, or t

SEQ ID NO: 263667 - DNA, 281 bp, Homo sapiens; identical to SEQ ID NO: 263523
  misc_feature: GYAE6OF01DUT27.24.53.E09.1.454.CMB.1.raw
  modified_base (281)..(281): a, c, t, g, unknown or other
  misc_feature (281)..(281): n is a, c, g, or t

SEQ ID NO: 263668 - DNA, 297 bp, Homo sapiens
  misc_feature: GYAE6OF01EZO5E.24.53.E09.1.454.CMB.1.raw
  modified_base (280)..(280): a, c, t, g, unknown or other
  misc_feature (280)..(280): n is a, c, g, or t
  modified_base (282)..(297): a, c, t, g, unknown or other
  misc_feature (282)..(297): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagntnnnnnnnnnnnnnnnn

SEQ ID NO: 263669 - DNA, 279 bp, Homo sapiens
  misc_feature: GYAE6OF01CAKPC.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagn

SEQ ID NO: 263670 - DNA, 444 bp, Homo sapiens
  misc_feature: GYAE6OF01B12AC.24.53.E09.1.454.CMB.1.raw
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
  modified_base (433)..(444): a, c, t, g, unknown or other
  misc_feature (433)..(444): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggaggtnattactacgtgccagtcgtcgaagtntggttcggcggagggactaagctgaccgtctaggtccagccccgaaggctcgcccctggtcactctcgttccccacctcctcacatagtagtctgagcgggctggcaaggcgcatagnnnnnnnnnnnn

SEQ ID NO: 263671 - DNA, 440 bp, Homo sapiens
  misc_feature: GYAE6OF01AYRHK.24.53.E09.1.454.CMB.1.raw
  modified_base (432)..(440): a, c, t, g, unknown or other
  misc_feature (432)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagccccaaggcctgccccctcggtcactctgttccccaccctcctcacatagtagtctgagcgggctgggcaaggcgcatagnnnnnnnnn

SEQ ID NO: 263672 - DNA, 279 bp, Homo sapiens; identical to SEQ ID NO: 263669
  misc_feature: GYAE6OF01CMIYJ.24.53.E09.1.454.CMB.1.raw
  modified_base (279)..(279): a, c, t, g, unknown or other
  misc_feature (279)..(279): n is a, c, g, or t

SEQ ID NO: 263673 - DNA, 282 bp, Homo sapiens
  misc_feature: GYAE6OF01AJWRN.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggttggggtgtggtggtctccacttcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagnnnn

SEQ ID NO: 263674 - DNA, 445 bp, Homo sapiens
  misc_feature: GYAE6OF01AUYFP.24.53.E09.1.454.CMB.1.raw
  modified_base (435)..(445): a, c, t, g, unknown or other
  misc_feature (435)..(445): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatggagggtgattactactgccagtcgtcgaagagtgttcgggcggagggactaagctcgaccgtctaggtcagcccaaggctcgcccctggtcactctcgtcccaccctcctcacatagtagtctgacgcgggctggcgaaggccgacatagnnnnnnnnnnn

SEQ ID NO: 263675 - DNA, 593 bp, Homo sapiens
  misc_feature: GYAE6OF01EAVQI.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtacttttggatgacctgggtccgccaggctccgagggacgggctggagtgggtggccaatataaggcacgatggacgtagcatgtactatgtggactctgtgaagggccattcaccatctccagagacaacgcccagaactcactgtatctaggaaatgaccagcctgagagtcgagacacggctatgtattactgtgcgaccatatcagcaccgtggacgtcgcatctagaactacttccagctagttggggccagggccacccgtggtccaccgtcctcctcacgtccctaccgaccgaacgggcccctagtcccggttcccttcccccgcggcccgccctcgcctccgacggacgccgtaccctccggacgacgaccgaccgacggcccggcccgtgggcctccggtccgtacgggtccaacgggtaccttacccgttacccaacgttacgtaaggttcgtcgtacggg

SEQ ID NO: 263676 - DNA, 443 bp, Homo sapiens
  misc_feature: GYAE6OF01CRRXV.24.53.E09.1.454.CMB.1.raw
  modified_base (283)..(283): a, c, t, g, unknown or other
  misc_feature (283)..(283): n is a, c, g, or t
  modified_base (434)..(443): a, c, t, g, unknown or other
  misc_feature (434)..(443): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagattccaaaaacagcccccaaactcctcatttatcgtaaacaacaatcggccctctggggtccctgaccgattctccgcctccaagtctggcacctcagcctcgctggccatcactgggctccaggctgaggangagggtgattactactgccagtcgtcgaagatggttcggcggagggactaagctgaccgtctaggtcagcccaaggctcgccccctcggtcactcctcgttccccaccctccctcacatagtatctgaggcgggctggcaaggcgcatagnnnnnnnnnn

SEQ ID NO: 263677 - DNA, 288 bp, Homo sapiens
  misc_feature: GYAE6OF01C8J96.24.53.E09.1.454.CMB.1.raw
  modified_base (282)..(288): a, c, t, g, unknown or other
  misc_feature (282)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctcacatagtagtctgagcgggctggcaaggcgcatagnnnnnnn

SEQ ID NO: 263678 - DNA, 438 bp, Homo sapiens
  misc_feature: GYAE6OF01BEPIX.24.53.E09.1.454.CMB.1.raw
  modified_base (424)..(438): a, c, t, g, unknown or other
  misc_feature (424)..(438): n is a, c, g, or t
tcagactactatgtcacgaccggtgctcgatttagagagagtgtgttgggttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgaggtgattactactgccagtcgtcgaagatggtcggcggaggactaagctgaccgtctaggtcagcccaaggctcgcccctggtcactctcgtccccgcctctcactatagtagtctgacgcgggctggcaaggcgcatagnnnnnnnnnnnnnnn

SEQ ID NO: 263679 - DNA, 281 bp, Homo sapiens; identical to SEQ ID NO: 263461
  misc_feature: GYAE6OF01BUF6R.24.53.E09.1.454.CMB.1.raw
  modified_base (280)..(281): a, c, t, g, unknown or other
  misc_feature (280)..(281): n is a, c, g, or t

SEQ ID NO: 263680 - DNA, 282 bp, Homo sapiens
  misc_feature: GYAE6OF01COSSF.24.53.E09.1.454.CMB.1.raw
  modified_base (282)..(282): a, c, t, g, unknown or other
  misc_feature (282)..(282): n is a, c, g, or t
tcagactactatgtcacgaccggtgctcgatttagagagagtgtgttgggtttgggggtgtggtggtctccactcccgccttgacggggctgctatctgcctcgctggccatcacgtgggctccaggctgaggatgagggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagn

SEQ ID NO: 263681 - DNA, 432 bp, Homo sapiens
  misc_feature: GYAE6OF01B1KXO.24.53.E09.1.454.CMB.1.raw
  modified_base (421)..(421): a, c, t, g, unknown or other
  misc_feature (421)..(421): n is a, c, g, or t
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagaccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtccactctcgttcccgccctcctcacatagtagtctgagcgggctggcaaggcncatagnnnnnn

SEQ ID NO: 263682 - DNA, 428 bp, Homo sapiens
  misc_feature: GYAE6OF01EBFDO.24.53.E09.1.454.CMB.1.raw
  modified_base (419)..(419): a, c, t, g, unknown or other
  misc_feature (419)..(419): n is a, c, g, or t
  modified_base (424)..(428): a, c, t, g, unknown or other
  misc_feature (424)..(428): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggaggactaagctgaccgtctaggtcagcccaaggctgcccctggtcactctgtccccaccctcctcacatagtagtctgagcgggctggcaaggcnatagnnnnn

SEQ ID NO: 263683 - DNA, 285 bp, Homo sapiens
  misc_feature: GYAE6OF01CTE93.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggtgattactactgccagtcgtcgaagatgttcggcggagggactaagctgaccgtcctaggtcagcccaaggctgccccctggtcactctcgttcccaccctcctcacatagtagtctggagcgggctggcaaggcgcatagnnnnnn

SEQ ID NO: 263684 - DNA, 281 bp, Homo sapiens; identical to SEQ ID NO: 263461
  misc_feature: GYAE6OF01BSHUR.24.53.E09.1.454.CMB.1.raw
  modified_base (280)..(281): a, c, t, g, unknown or other
  misc_feature (280)..(281): n is a, c, g, or t

SEQ ID NO: 263685 - DNA, 430 bp, Homo sapiens
  misc_feature: GYAE6OF01DV6U0.24.53.E09.1.454.CMB.1.raw
  modified_base (419)..(419): a, c, t, g, unknown or other
  misc_feature (419)..(419): n is a, c, g, or t
  modified_base (425)..(430): a, c, t, g, unknown or other
  misc_feature (425)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactgggctccaggctgagatgaggtgattactactgccagtcgtcgaagatggttcggcggagggactaagctgaccgtctaggtcagcccaaggctgcccctggtcactctcgttcccgccctcctcacatagtagtctgagcgggctggcaaggcncatagnnnnnn

SEQ ID NO: 263686 - DNA, 432 bp, Homo sapiens
  misc_feature: GYAE6OF01D5922.24.53.E09.1.454.CMB.1.raw
  modified_base (422)..(422): a, c, t, g, unknown or other
  misc_feature (422)..(422): n is a, c, g, or t
  modified_base (428)..(432): a, c, t, g, unknown or other
  misc_feature (428)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacatcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctcgttccccaccctcctcacatagtagtctgagcgggctggcaaggcncatagnnnnn

SEQ ID NO: 263687 - DNA, 434 bp, Homo sapiens
  misc_feature: GYAE6OF01BISV7.24.53.E09.1.454.CMB.1.raw
  modified_base (391)..(391): a, c, t, g, unknown or other
  misc_feature (391)..(391): n is a, c, g, or t
  modified_base (429)..(434): a, c, t, g, unknown or other
  misc_feature (429)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagcgtgaccgtctaggtcagcccaaggctcgcccctcggtcactctcgttcccaccctccncacatagtagtctgagcggggctggcaaggcgcatagnnnnnn

SEQ ID NO: 263688 - DNA, 284 bp, Homo sapiens; identical to SEQ ID NO: 263514
  misc_feature: GYAE6OF01AJDAR.24.53.E09.1.454.CMB.1.raw
  modified_base (280)..(284): a, c, t, g, unknown or other
  misc_feature (280)..(284): n is a, c, g, or t

SEQ ID NO: 263689 - DNA, 541 bp, Homo sapiens
  misc_feature: GYAE6OF01CSY48.24.53.E09.1.454.CMB.1.raw
  modified_base (243)..(243): a, c, t, g, unknown or other
  misc_feature (243)..(243): n is a, c, g, or t
tcagactactatgtcacgaccggtgctcgatttagagagagtgtgttgggtttgggaggcttggtccagccgtgggggtccctgagactctcctgtgcagcctctggattcccctttagtgtactttttggatgacctgggtccgccaggctccgagggacgggctggagtgggtggccaaatataaggcacgatggacgtagcatgtactatgtggactctgtgaagggccattcaccatcnccagagacaacgcccagaacctcactgtatctggaaatgaccagcctgagagtcgaggacacggctatgtatactgtgcgaccatatcagcaacctggagtcgcatctgaatacttccagcattggggccagggcaccctggtcaccgtctcctcagcctcaccaaggcccatcggtccttcccctggccgccctgctccgaggacgcaccctccgagacgcaacacgccggaccccgtgggccgtcggcccttgggccaaacgggaccttaccgttaccacaatagtagtctacggg

SEQ ID NO: 263690 - DNA, 635 bp, Homo sapiens
  misc_feature: GYAE6OF01CQSGM.24.53.E09.1.454.CMB.1.raw
  modified_base (163)..(163): a, c, t, g, unknown or other
  misc_feature (163)..(163): n is a, c, g, or t
  modified_base (185)..(185): a, c, t, g, unknown or other
  misc_feature (185)..(185): n is a, c, g, or t
  modified_base (302)..(302): a, c, t, g, unknown or other
  misc_feature (302)..(302): n is a, c, g, or t
  modified_base (601)..(601): a, c, t, g, unknown or other
  misc_feature (601)..(601): n is a, c, g, or t
  modified_base (603)..(635): a, c, t, g, unknown or other
  misc_feature (603)..(635): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgcaggttttgatgtccactggtacaagcagcttaccaaaaacncgacccccaaatcctcatttancgtaaacaacaatccggccctgtcggggtccctgaccgattcctccgcctccaaggtctggccacctcacgcctcgctcggccatccacgtggctccaggctggaggatggagggtnacttactactcgccgtagtcgtacgaagtattggttacgggcggacgggacttaacggcgtacggtaaccccggttccgtaacggtccgaacggtaccccgaaacggggtccccttaccgggccccccccgtttacggggtaccctaaccgttttccccgtttaccccggtttacccccccctaaacccccctttccctaaaccggaacccttaagttaacggttaaccgggttccgttacggggtacggccgggggtaccgttacggggaccgtaaacggggccgaccgtaagtaggngnnnnnnnnnnnnnnnnnnnnnnnnnnnnnnnnn

SEQ ID NO: 263691 - DNA, 443 bp, Homo sapiens
  misc_feature: GYAE6OF01BN5IR.24.53.E09.1.454.CMB.1.raw
  modified_base (162)..(162): a, c, t, g, unknown or other
  misc_feature (162)..(162): n is a, c, g, or t
  modified_base (428)..(443): a, c, t, g, unknown or other
  misc_feature (428)..(443): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngcccccaaactcctcatttatcgtaacaacaatccggccctctggggtccctgaccgattctccgcctccaagtctggccacctcagcctcgctggccatcactgggctccaggctgaggatgaggtgattacactgccagtcgtcgaagatggtcggcggagggactaagctgaccgtctaggtcagcccaaggcctcgcccctgcactctcgttccccacctcctcacatacgtagtctgaggcggctggacaaggcgcatagnnnnnnnnnnnnnnnn

SEQ ID NO: 263692 - DNA, 301 bp, Homo sapiens
  misc_feature: GYAE6OF01CCZDE.24.53.E09.1.454.CMB.1.raw
  modified_base (282)..(285): a, c, t, g, unknown or other
  misc_feature (282)..(285): n is a, c, g, or t
  modified_base (287)..(301): a, c, t, g, unknown or other
  misc_feature (287)..(301): n is a, c, g, or t
tcagactactatgtcacgaccggtgctcgatttagagagagtgtgttggggtttgggggtgtggtggtctccactcccgccttggacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnncnnnnnnnnnnnnnnn

SEQ ID NO: 263693 - DNA, 440 bp, Homo sapiens
  misc_feature: GYAE6OF01BSLVE.24.53.E09.1.454.CMB.1.raw
  modified_base (314)..(314): a, c, t, g, unknown or other
  misc_feature (314)..(314): n is a, c, g, or t
  modified_base (428)..(428): a, c, t, g, unknown or other
  misc_feature (428)..(428): n is a, c, g, or t
  modified_base (434)..(440): a, c, t, g, unknown or other
  misc_feature (434)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagntgttcggcggagggactaagctgaccgtctaggtcagcccaaggctcgccccctcggtcactctcgttccccaccctcctcacattacgtagtctgagcgggctggcaaggccncatagnnnnnnn

SEQ ID NO: 263694 - DNA, 765 bp, Homo sapiens
  misc_feature: GYAE6OF01BT1G3.24.53.E09.1.454.CMB.1.raw
tcagactactatgtcacgaccggtgctcgatttagagagagtgtgttgggtttggggaggcttggtccagccgtggggggtccctgagactctcctgtgcagcctctggactttcccctttagtgtactttttggatgacctgggtccgccaggctccgagggacgggctggaggtgggtggaccaatataaggcacgatggacgtagcatgtactatgtgactctgtgaaggcgattcaccatctcagagacaacgccagaactcactgtatcgtaggaaatgaccagcctgagagtcgaggacacggcttagtgttaattacgtgtcgaccgaacctattacgtacacgacctaaccgtgggaacgtccgactaatccgtagaaactttacccgttaccgaaggtacttaacgggtttccggggggaccctaaacgggggtcccctaaccccggttcgggttacccgtaaccccggttcccttaccccgttacccgaacccggttacccccttaacccccggaaacccggaaacccggggtcccccctaaccgggtttacccccgggtttcccccgttttcccccccggtcgggtcccccgtccccgtcggtacccgttacccgaacgggtaccgaccccgtaacccgtaccgacgacccgaccgaccgaccgggcccggtcccggtacgggcccttcggacccgttacgggtaccaaccggtaccttacccgtaccgaactagtacggttacgtcgtacggg

SEQ ID NO: 263695 - DNA, 439 bp, Homo sapiens
  misc_feature: GYAE6OF01AW96O.24.53.E09.1.454.CMB.1.raw
  modified_base (415)..(415): a, c, t, g, unknown or other
  misc_feature (415)..(415): n is a, c, g, or t
  modified_base (433)..(439): a, c, t, g, unknown or other
  misc_feature (433)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctggagatgaggtgattactactgccagtcgtacgaagatgttcggcggagggactaagctgaccgtccgaggtcacgcccaaggctcgcccctggtccactctcgttccccaccctcctcacatagtagctgaggccggntcggcaacggcgcatagnnnnnnn

SEQ ID NO: 263696 - DNA, 351 bp, Homo sapiens
  misc_feature: GYAE6OF01C3F5Q.24.53.E09.1.454.CMB.1.raw
  modified_base (233)..(233): a, c, t, g, unknown or other
  misc_feature (233)..(233): n is a, c, g, or t
  modified_base (308)..(351): a, c, t, g, unknown or other
  misc_feature (308)..(351): n is a, c, g, or t
tcagactactatgtcacgaccggtgctcgatttagagagagtgtgttggggttttgggggggtgtggtggtctccactcccgccttggacggggctgctatcgtgtcctcgcgtcggcctatcacgttgggcctccgaggctgaggatggagggtgattactacgtgccagtcgtacgaagatggttcggcggaaggactaagctcgaccgtctaggcacgcccaaggctccncccctgcactctcgtccccaccctccacatagttagtacgtgacggacggcggacgaacggacgacgacgatagnnnnnnnnnnnnnnnnnnnnnnnnnnnnnnnnnnnnnnnnnnnn

SEQ ID NO: 263697 - DNA, 471 bp, Homo sapiens
  misc_feature: GYAE6OF01EZEY7.24.53.E09.1.454.CMB.1.raw
  modified_base (184)..(184): a, c, t, g, unknown or other
  misc_feature (184)..(184): n is a, c, g, or t
  modified_base (442)..(442): a, c, t, g, unknown or other
  misc_feature (442)..(442): n is a, c, g, or t
  modified_base (449)..(471): a, c, t, g, unknown or other
  misc_feature (449)..(471): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagcttaccaaaaacagccccccaaactcctcatttancgtaaacaacaatcggccctctggggtccctgaccgattctccgcctccaagtctggcacctcagcctcgctggccatcactgggctccaggctgaggatgagggtgattactactgccagtcgtcgaagatgtcggcggagggactaagctgaccgtctaggtcagcccaaggctcgcccccgtcgtcctactcgtcccgtccctccctcctacactagtagtacgtcgaggcggcggtcgtacggacgacggcganagtacgnnnnnnnnnnnnnnnnnnnnnnn

SEQ ID NO: 263698 - DNA, 574 bp, Homo sapiens
  misc_feature: GYAE6OF01BWZ2K.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcaccgtggagtcgcatctgaacttacttccagcagttggggccagggcacccgtggtccaccgtctcctcacgcctccaccgacggcccagtccggtcccttcccccgtggcccgccctcgcctccaggcgccgaccctccgagacgccacgacggccggccccgtgggcctcggcccgttgggtcccaaacgggtacccttaaccgttcccaactaagttacggttacggtccgtacggg

SEQ ID NO: 263699 - DNA, 281 bp, Homo sapiens; identical to SEQ ID NO: 263580
  misc_feature: GYAE6OF01A0LMU.24.53.E09.1.454.CMB.1.raw
  modified_base (279)..(281): a, c, t, g, unknown or other
  misc_feature (279)..(281): n is a, c, g, or t

SEQ ID NO: 263700 - DNA, 282 bp, Homo sapiens
  misc_feature: GYAE6OF01CIV5Q.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagnnn

SEQ ID NO: 263701 - DNA, 439 bp, Homo sapiens
  misc_feature: GYAE6OF01DJ3A6.24.53.E09.1.454.CMB.1.raw
  modified_base (225)..(225): a, c, t, g, unknown or other
  misc_feature (225)..(225): n is a, c, g, or t
  modified_base (322)..(322): a, c, t, g, unknown or other
  misc_feature (322)..(322): n is a, c, g, or t
  modified_base (429)..(439): a, c, t, g, unknown or other
  misc_feature (429)..(439): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaaacagccccccaaaactcctcatttatcgtaacaacaatcggccctctggggtccctgaccgattcnccgcctccaagtctggcacctcagcctcgctggccatcactgggctccaggctgaggatgagggtgattactactgccagtcgtcgaagatgtcggnggagggactaagctgaccgtctaggtcacgcccaaggctcgcccctggtcactctcgttcccaccctcctcacatagtatctgagcgggctggacaaggcgcatagnnnnnnnnnnn

SEQ ID NO: 263702 - DNA, 435 bp, Homo sapiens
  misc_feature: GYAE6OF01DLP6Y.24.53.E09.1.454.CMB.1.raw
  modified_base (429)..(435): a, c, t, g, unknown or other
  misc_feature (429)..(435): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaaacagcccccaaaactcctcatttatcgtaaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgtcccaccctctcacatagtagtctgagcgggctggcaaggcgcatagnnnnnnn

SEQ ID NO: 263703 - DNA, 285 bp, Homo sapiens
  misc_feature: GYAE6OF01CILFP.24.53.E09.1.454.CMB.1.raw
  modified_base (283)..(285): a, c, t, g, unknown or other
  misc_feature (283)..(285): n is a, c, g, or t
tcagactactatgtcacgaccggtgctcgatttagagagagtgtgttgggtttgggggtgtggtggtctccactcccgccttgacggggctgttatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtagtctgagcgggctggcaaggcgcatagnnn

SEQ ID NO: 263704 - DNA, 283 bp, Homo sapiens
  misc_feature: GYAE6OF01DXTXF.24.53.E09.1.454.CMB.1.raw
  modified_base (275)..(275): a, c, t, g, unknown or other
  misc_feature (275)..(275): n is a, c, g, or t
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctgttccccaccctcctcacatagtagtctgagcgggctggcaaggcncatagnnn

SEQ ID NO: 263705 - DNA, 441 bp, Homo sapiens
  misc_feature: GYAE6OF01DGDAD.24.53.E09.1.454.CMB.1.raw
  modified_base (439)..(441): a, c, t, g, unknown or other
  misc_feature (439)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacagccccccaaaactcctcatttatcgtaaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtcctaggtcagcccaaggcctcgccccctggtcactctcgttccccacctcctcacatagtagtctggagcgggctggacaaggccgcatagnnn

SEQ ID NO: 263706 - DNA, 289 bp, Homo sapiens
  misc_feature: GYAE6OF01DGEGX.24.53.E09.1.454.CMB.1.raw
  modified_base (280)..(289): a, c, t, g, unknown or other
  misc_feature (280)..(289): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgcccctcggtcactctgttcccaccctcctcacatagtagtctgagcgggctggcaaggcgcatagnnnnnnnnnn

SEQ ID NO: 263707 - DNA, 439 bp, Homo sapiens
  misc_feature: GYAE6OF01AVW4I.24.53.E09.1.454.CMB.1.raw
  modified_base (421)..(421): a, c, t, g, unknown or other
  misc_feature (421)..(421): n is a, c, g, or t
  modified_base (427)..(439): a, c, t, g, unknown or other
  misc_feature (427)..(439): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaagctcgcccctcggtcactctcgtccccgcctcctcacatagtagtctgagcgggctggcaaggcncatagnnnnnnnnnnnnn

SEQ ID NO: 263708 - DNA, 442 bp, Homo sapiens
  misc_feature: GYAE6OF01AGHMG.24.53.E09.1.454.CMB.1.raw
  modified_base (321)..(321): a, c, t, g, unknown or other
  misc_feature (321)..(321): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (432)..(442): a, c, t, g, unknown or other
  misc_feature (432)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgccccccaaactcctcatttatcgtaacaacaatcggccctcgtggggtccctgaccgattcctccgcctccaagtctggcacctcagcctcgctggccatcactgggcctccgaggctgaggatggagggtgattactactgccagtcgtcgaagngtggttcggcggagggactagctgaccgtcaggtcacgccaagctcgcccctggccactctcgttccccacctcctcacatagtgtctgagcgggntggcaggcncagtgnnnnnnnnnnn

SEQ ID NO: 263709 - DNA, 431 bp, Homo sapiens
  misc_feature: GYAE6OF01BC62F.24.53.E09.1.454.CMB.1.raw
  modified_base (161)..(161): a, c, t, g, unknown or other
  misc_feature (161)..(161): n is a, c, g, or t
  modified_base (315)..(315): a, c, t, g, unknown or other
  misc_feature (315)..(315): n is a, c, g, or t
  modified_base (422)..(431): a, c, t, g, unknown or other
  misc_feature (422)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactggctcaggctgagatgaggtgattactactgccagtcgtcgaagatgttcggnggagggactaagctgaccgtctaggtcagcccaaggctcgccccctggtccactctcgtcccacctctcacatagtagtctagacgcgggctggcaaggcgcatagnnnnnnnnnn

SEQ ID NO: 263710 - DNA, 550 bp, Homo sapiens
  misc_feature: GYAE6OF01AL6GQ.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccgaggggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttcagcagttggggcagggcacccgtgtcaccgtctcctcacgcctccaaccaacgggcccacgtccgtccttccccgcggccgccctcgcctccgacggacgcctacccgtccgacgacgacacgacgccgccgtcgggacgtcgccgtgggtccaacggtaccttacttcccaacataggtgtcgtacggg

SEQ ID NO: 263711 - DNA, 435 bp, Homo sapiens
  misc_feature: GYAE6OF01BJL1G.24.53.E09.1.454.CMB.1.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
  modified_base (386)..(386): a, c, t, g, unknown or other
  misc_feature (386)..(386): n is a, c, g, or t
  modified_base (420)..(420): a, c, t, g, unknown or other
  misc_feature (420)..(420): n is a, c, g, or t
  modified_base (426)..(435): a, c, t, g, unknown or other
  misc_feature (426)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactggctccaggctgagatgaggtnattacactgccagtcgtgaagatgtcggnggaggactaagctgaccgtcctaggtcacgcccaaggcctcgcccctcggtcactctcgtccccacctcncacatagtagtctgacgcgggctggcaaggcganagtagnnnnnnnnnn

SEQ ID NO: 263712 - DNA, 549 bp, Homo sapiens
  misc_feature: GYAE6OF01ATKYQ.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgacatatcagcacctggagtcgcatctgaatacttcagcagttggggccagggccacctggtcaccgtctcctcacgccctccacccaacgggcccacgtccggtcccttcccccgtcggccgccctcgcctccgaggacgccacccgtccgagacgcaccgacggccgcccgtcgggcctcgccctgggtcaacgggtaccttacgttccacatagtagtcgtacggg

SEQ ID NO: 263713 - DNA, 377 bp, Homo sapiens
  misc_feature: GYAE6OF01CO3X4.24.53.E09.1.454.CMB.1.raw
  modified_base (371)..(377): a, c, t, g, unknown or other
  misc_feature (371)..(377): n is a, c, g, or t
tcagactactatgtcacgaccggtgctcgatttagagagagtgtgttgggtttgggagcaacatcggcgcaggttttgatgtccactggtacaagcagcttccaaaaacagccccaaactcctcatttatcgtaacaacaatcggccctctgggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgcccctggtcactctgttcccaccctcctcacatagtagtctgagcgggctggcaaggcgcatagnnnnnnn

SEQ ID NO: 263714 - DNA, 566 bp, Homo sapiens
  misc_feature: GYAE6OF01AZP0P.24.53.E09.1.454.CMB.1.raw
tcagactactatgtcacgaccggtgctcgatttagagagagtgtgttgggtttgggaggcttggtccagcctggggggtccctgagactctcctgtgcagcgtctggacacatcttcaatacctatggcatgcactgggtccgccaggctccaggcaaggggctggagtgggtggcagttatttggtttgatggaactaatgaatactatgcagagtccgtgaagggccgattcaccatctccagagacaattccaggagaattttgtatcttcagatgaacagcctgagagtcgaggacacggctatgtattactgtgcgatgaaagcaggaggatggttcgagtgggagcttcgaggctggacgttttgggggaccctaggggaacccttgggtccaccgtctcctcacgtcctacccaccgaacgggccccagtcccggtcccttcccccgtggccgccccgtgcctccgaggacgccacccgtcgagacgcacacggccgcccgtgggcctgcccgtggtaccgaacggtaccttaccgttccaacgtacttaggtcgtcgg

SEQ ID NO: 263715 - DNA, 283 bp, Homo sapiens
  misc_feature: GYAE6OF01A1JHP.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgagtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnn

SEQ ID NO: 263716 - DNA, 434 bp, Homo sapiens
  misc_feature: GYAE6OF01A5M6P.24.53.E09.1.454.CMB.1.raw
  modified_base (430)..(434): a, c, t, g, unknown or other
  misc_feature (430)..(434): n is a, c, g, or t
tcagactactatgtcacgaccggtgctcgatttagagagagtgtgttgggttgggggctgttttggaagctgcttgtaccagagggtcaccatctcctgcactgggagcaacatcggcgcaggtttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggtagggactaagctgaccgtctaggtcagcccaaggctcgccccctcggtcactctcgttcccgccctcctcacatagtagtctggagcggggctgggcaaggcgcatagnnnnn

SEQ ID NO: 263717 - DNA, 332 bp, Homo sapiens
  misc_feature: GYAE6OF01BXWT5.24.53.E09.1.454.CMB.1.raw
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(332): a, c, t, g, unknown or other
  misc_feature (292)..(332): n is a, c, g, or t
tcagactactatgtcacgaccggtgctcgatttagagagagtgtgttgggggtttgggggtgtggtggtctccactcccgccttggacggggctgctatctgcctcgctggccattcactgggctccaggctggaggatggagggtgacttactactgccagtcgtcgaagatgttcggcggagggactaaggctgaccgtctaggtcagcccaaggctgccccctggtcactctacgttcccaccctcctcacatagtagtctgagcgggctggcaaggcacatagnancnnnnnnnnnnnnnnnnnnnnnnnnnnnnnnnnnnnnnnnnn

SEQ ID NO: 263718 - DNA, 767 bp, Homo sapiens
  misc_feature: GYAE6OF01BOA49.24.53.E09.1.454.CMB.1.raw
tcagactactatgtcacgaccggtgctcgatttagagagagtgtgttgggtttgggggctgttttggaagctgcttgtaccagagggtctaccatcttcctgtcactgggagcaacatcggcgcaggttttgatgtccactggtacaagcagcttaccaaaactcgcccccaaatcctctaatttatcgtaacaacaatcggcctctgggtccctgaccgattctccgcctccaagtctggccaccgtcagcctcgctggccatcactgggctccaggtctggaggatggagggtgacttactactcggacctaggtccgtacggaaggtacttcgggttacgggacggggaggggtacgtaaagggtccgttcggtaacccggttcccgttaagggttccgaacggtacccccggtaaaggggtcccgttacccggacccccccgttaccggggttccaacccgtttccccgtttaccccgggttttaccccccgtaaaccccccggttccccgttacccgtaaacccgttaaccgtttaaccgggtttaaccggtttccccgttaagggggaaccccgggtcccggggggtacccttaccggggaacccgaaaacggggtcccggaaccgtaaacgtttacgggtcacgtacgtacgacgtacacgacgacgcgcgtacgacgtacgacgacgacgtactactactacgtacgtcgtagtacggtcggtcgggtcggtacggtcgtacgtcgtcgttgtcgtacg

SEQ ID NO: 263719 - DNA, 361 bp, Homo sapiens
  misc_feature: GYAE6OF01C015O.24.53.E09.1.454.CMB.1.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (303)..(361): a, c, t, g, unknown or other
  misc_feature (303)..(361): n is a, c, g, or t
tcagactactatgtcacgaccggtgctcgatttagagagagtgtgttggggttttggggggggtgtggtggtcctccactcccgccttgacggggctgctatctgccgtccgctggccatcacgtgggctccaggctgaggatgagggtgattactactgccagtcgtacgaagatgttcggcggaggactaagctgaccgtcaggtcagcccaaggctcgcccctggtcactctcgttcccgcctccgtnacatagtcgtatggagcgggcttggacaaggcgacatagcanacngcatcannnnnnnnnnnnnnnnnnnnnnnnnnnnnnnnnnnnnnnnnnnnnnnnnnnnnnnnnnn

SEQ ID NO: 263720 - DNA, 279 bp, Homo sapiens
  misc_feature: GYAE6OF01BCZUN.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatag

SEQ ID NO: 263721 - DNA, 441 bp, Homo sapiens
  misc_feature: GYAE6OF01CLQLG.24.53.E09.1.454.CMB.1.raw
  modified_base (432)..(441): a, c, t, g, unknown or other
  misc_feature (432)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtccgtaggtcagcccaaggctcgccccctggtcactctcgttccccacctcctcacatacgtagtctgagcgggctggcaaggcgcagtagnnnnnnnnnn

SEQ ID NO: 263722 - DNA, 513 bp, Homo sapiens
  misc_feature: GYAE6OF01ETVOA.24.53.E09.1.454.CMB.1.raw
  modified_base (289)..(291): a, c, t, g, unknown or other
  misc_feature (289)..(291): n is a, c, g, or t
  modified_base (293)..(293): a, c, t, g, unknown or other
  misc_feature (293)..(293): n is a, c, g, or t
  modified_base (296)..(297): a, c, t, g, unknown or other
  misc_feature (296)..(297): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (319)..(320): a, c, t, g, unknown or other
  misc_feature (319)..(320): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (331)..(332): a, c, t, g, unknown or other
  misc_feature (331)..(332): n is a, c, g, or t
  modified_base (337)..(338): a, c, t, g, unknown or other
  misc_feature (337)..(338): n is a, c, g, or t
  modified_base (340)..(341): a, c, t, g, unknown or other
  misc_feature (340)..(341): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagactactatgtcacgaccggtgctcgattttagagagagtgtgttggggtttggggggtagtggtggtcctaccactcccgccttgacgggctgctatctgtccctgctggccatcactggctccagctgaggatgaggtgattactatgccagtcgtcgaagatgtcggcggaggactaagctgaccgtctaggtcagcccaaggctcgccccctggtcactcgtcgttccccgccctcctcgaacatagtacgtctgagcgggctggacaaaggcgacatacgnnnangcnncganctcgngcacgcagcngtnntagngngtgannagatnntnncancgagtgngatactnacanacacngtangacgagtntacgtatcgacattagatatacacgtacgtacgtactacgtacgtactacgtacgtacgtacgtacgtgtacgtacgtacgtacgtacgtagacgtacgtacgtacgacgtacgtacgtacgtcgtcgtcgtcg

SEQ ID NO: 263723 - DNA, 439 bp, Homo sapiens
  misc_feature: GYAE6OF01D21K7.24.53.E09.1.454.CMB.1.raw
  modified_base (291)..(291): a, c, t, g, unknown or other
  misc_feature (291)..(291): n is a, c, g, or t
  modified_base (426)..(426): a, c, t, g, unknown or other
  misc_feature (426)..(426): n is a, c, g, or t
  modified_base (431)..(439): a, c, t, g, unknown or other
  misc_feature (431)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctcggggtccctgaccgattctccgcctccaagtctggcacctcagcctcgctggccatcactgggctccaggctgaggatgagggtnattactactgccagtcgtacgaagatggtcggcggaggactaagctgaccgtctaggtcacgccaagctcgcccctggtcactctcgtcccgccctctcacatacgtagtctgaggcgggctggacaaggccganatagnnnnnnnnn

SEQ ID NO: 263724 - DNA, 441 bp, Homo sapiens
  misc_feature: GYAE6OF01AES9G.24.53.E09.1.454.CMB.1.raw
  modified_base (162)..(162): a, c, t, g, unknown or other
  misc_feature (162)..(162): n is a, c, g, or t
  modified_base (223)..(223): a, c, t, g, unknown or other
  misc_feature (223)..(223): n is a, c, g, or t
  modified_base (430)..(441): a, c, t, g, unknown or other
  misc_feature (430)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattcnccgcctccaagtctggcacctcagcctcgctggccatcactgggctccaggctgaggatgagggtgattactactgccagtcgtcgaagagtggttcggcggagggactaagctgaccgtctaggtcagccaaggctcgcccctggtcactctcgtccccgccctcctcacatagtgtctgaggcgggctggacaaggcgcagtagnnnnnnnnnnnn

SEQ ID NO: 263725 - DNA, 461 bp, Homo sapiens
  misc_feature: GYAE6OF01CU29Z.24.53.E09.1.454.CMB.1.raw
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (442)..(461): a, c, t, g, unknown or other
  misc_feature (442)..(461): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagccccccaaaactcctcatttatcgtaaacaacaatcggccctctggggtccctgaccgattctccgcctccaagtctggcacctcagcctcgctggccatcactggctccaggctgaggatgagggtgattactatcgccagtcgtcgaagtatggttcggcggaggactaagctgaccgtctagtcagccaaggcncgccccngtcactctcgtccccacctcctcactatagtacgtctaggacgtacggggctcgggacgaacggcacgagtacgnnnnnnnnnnnnnnnnnnnn

SEQ ID NO: 263726 - DNA, 464 bp, Homo sapiens
  misc_feature: GYAE6OF01DWS2R.24.53.E09.1.454.CMB.1.raw
  modified_base (140)..(140): a, c, t, g, unknown or other
  misc_feature (140)..(140): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
tcagactactatgtcacgaccggtgctcgatttagagagagtgtgttgggtttgggggtgtggtggtctccactcccgccttgacggggctgctatctgcctcgctggccatcactgggctcaggctgaggatgagggtnattactactgccagtcgtcgaagatgttcggcggaggactaagctgaccgtcctaggtcagcccaaggctcgccccctgtcactctcgttccccacctcctacacatagtagtctgagtcggctaggacaaggccgactaatagnagcatgcantnacgntcgcagtacatcgatncgancgatgcgntcgatcgatcatncgngctagcatancgatcanagtcagctaancgagcaggccagtnacgtgaagtnaccganccgtagacttcagactgaatgncggtacncgancnganctgacgtgacncgtacnangtcgn

SEQ ID NO: 263727 - DNA, 461 bp, Homo sapiens
  misc_feature: GYAE6OF01BPD06.24.53.E09.1.454.CMB.1.raw
  modified_base (446)..(461): a, c, t, g, unknown or other
  misc_feature (446)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgacccccaaaactcctcatttatcgtaacaacaatcggccctctggggtccctgaccgattctccgcctccaagtctggcacctcagcctcgctggccatcactggctccaggctggaggatggaggtgattactactgccaggtcgtacgaagtatggttcggacggagggactaaggctgaccgtctaggtcacgcccaaggcctcgcccctggtcactcgtcgtccccgcctcctcactatacgtagtctggacgcgggtctgggcaaggcgcatacgnnnnnnnnnnnnnnnn

SEQ ID NO: 263728 - DNA, 338 bp, Homo sapiens
  misc_feature: GYAE6OF01EKW59.24.53.E09.1.454.CMB.1.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (298)..(299): a, c, t, g, unknown or other
  misc_feature (298)..(299): n is a, c, g, or t
  modified_base (301)..(338): a, c, t, g, unknown or other
  misc_feature (301)..(338): n is a, c, g, or t
tcagactactatgtcacgaccggtgctcgatttagagagagtgtggttgggtttggggggtgtggtggtcctccactcccgccttgacggggctgctatctgccgtccgctggccatcacgtgggctccaggctgaggatgacgggtgattactactgccagtcgtcgaagatcgttcggcggaggactaagctgaccgtcctaggtcagcccgaaggcctcgccccctggtccaccttctgttccccgccctcctacacatagtatctgacgtcgggctggcaaggcncaatagnannannnnnnnnnnnnnnnnnnnnnnnnnnnnnnnnnnnnnn

SEQ ID NO: 263729 - DNA, 454 bp, Homo sapiens
  misc_feature: GYAE6OF01EWB98.24.53.E09.1.454.CMB.1.raw
  modified_base (161)..(161): a, c, t, g, unknown or other
  misc_feature (161)..(161): n is a, c, g, or t
  modified_base (182)..(182): a, c, t, g, unknown or other
  misc_feature (182)..(182): n is a, c, g, or t
  modified_base (292)..(292): a, c, t, g, unknown or other
  misc_feature (292)..(292): n is a, c, g, or t
  modified_base (403)..(403): a, c, t, g, unknown or other
  misc_feature (403)..(403): n is a, c, g, or t
  modified_base (429)..(454): a, c, t, g, unknown or other
  misc_feature (429)..(454): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaatcctcatttancgtaacaacaatcggccctctggggtccctgaccgattccgcccgcctccaagtcctggcacctcagcctcgctggccatcactgggctccaggctgaggatggagggtnattacactgccagtcgtcgaagatggttcggcggagggactaagctgaccgtctaggcagcccaaggcctcgcccctgcactctcgtcccgcctcctcacatagtcgttcngacgcgggctcggacgaggcgcatgnnnnnnnnnnnnnnnnnnnnnnnnnn

SEQ ID NO: 263730 - DNA, 328 bp, Homo sapiens
  misc_feature: GYAE6OF01CUBTY.24.53.E09.1.454.CMB.1.raw
  modified_base (292)..(328): a, c, t, g, unknown or other
  misc_feature (292)..(328): n is a, c, g, or t
tcagactactatgtcacgaccggtgctcgatttagagagagtgtgttggggtttgggggggtgtggtggtcctccactcccgccttgacggggctgctatctggccctcgctggccatcacgtgggctccaggctgagggatgagggtgattactactgccagtcgtcgaagatgttcggcggagggactaagctgaccgtcctaggtcagcccaaggctcgccccctggtcactctcgttcccgccctcctcacatagtagtctggagcgggctggccaaggcgtcatagnnnnnnnnnnnnnnnnnnnnnnnnnnnnnnnnnnnnn

SEQ ID NO: 263731 - DNA, 292 bp, Homo sapiens
  misc_feature: GYAE6OF01A13C9.24.53.E09.1.454.CMB.1.raw
  modified_base (279)..(292): a, c, t, g, unknown or other
  misc_feature (279)..(292): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnnnnnnnnnnnn

SEQ ID NO: 263732 - DNA, 497 bp, Homo sapiens
  misc_feature: GYAE6OF01DCRCX.24.53.E09.1.454.CMB.1.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (463)..(464): a, c, t, g, unknown or other
  misc_feature (463)..(464): n is a, c, g, or t
  modified_base (466)..(497): a, c, t, g, unknown or other
  misc_feature (466)..(497): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttaccaaaaaacacgaccccccaaaactcctacattttatccgtaaacaacaatccggccctcgtggggtcccctgacccgattcctccgcctccaagtctggccacctcacgcctcgctggccatcactgggctccaggctgagatgagggtnattactactgccagtcgtcgaagntgtcggnggaggactaagctgaccgtctaggtcagcccaaggctcgccccctggtcactctcgttccccaccctcctacactatagtacgtctaggacgtccggggctgggacctaaaggggccacgaagtaggcnngnnnnnnnnnnnnnnnnnnnnnnnnnnnnnnnn

SEQ ID NO: 263733 - DNA, 442 bp, Homo sapiens
  misc_feature: GYAE6OF01DLSZZ.24.53.E09.1.454.CMB.1.raw
  modified_base (434)..(442): a, c, t, g, unknown or other
  misc_feature (434)..(442): n is a, c, g, or t
tcagactactatgtcacgaccggtgctcgatttagagagagtgtgttgggtttgggggctgtttttggaagctgcttgtaccagagggtcaccatctcctgcgactgggagcaacatcggcgcaggttttgatgtccactggtacaagcagcttaccaaaaacagccccccaaactcctcatttatcgtaacaacaatcggccctctggggtccctgaccgattctccgcctccaagtctggcacctcagcctcgctggccatcactgggctcaggctgaggatgagggtgattactactgccagtcgtcgaagatggtcggcggagggactaagctcgaccgtctaggtcacgccaaggctcgcccctggtcactctcgtttcccaccctcctcactatagtagtctgaggcgggctggacaaggcgcatagnnnnnnnnn

SEQ ID NO: 263734 - DNA, 280 bp, Homo sapiens
  misc_feature: GYAE6OF01DDVBQ.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccacactcctcacatagtagtctgagcgggctggcaaggcgcatagn

SEQ ID NO: 263735 - DNA, 283 bp, Homo sapiens
  misc_feature: GYAE6OF01DHJTZ.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggcctgccccctggtcactctcgttccccaccctcctcacatagtagtctgagcgggctggcaaggcgcatagnn

SEQ ID NO: 263736 - DNA, 283 bp, Homo sapiens
  misc_feature: GYAE6OF01CNUYH.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnn

SEQ ID NO: 263737 - DNA, 437 bp, Homo sapiens
  misc_feature: GYAE6OF01CWDPR.24.53.E09.1.454.CMB.1.raw
  modified_base (162)..(162): a, c, t, g, unknown or other
  misc_feature (162)..(162): n is a, c, g, or t
  modified_base (393)..(393): a, c, t, g, unknown or other
  misc_feature (393)..(393): n is a, c, g, or t
  modified_base (426)..(437): a, c, t, g, unknown or other
  misc_feature (426)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaaactcctcatttatcgtaacaacaatcggccctctggggtccctgaccgattctccgcctccaagtctggcacctcagcctcgctggccatcatgggctcaggctgaggatgagggtgattactactgccagtcgtcgaagatggttcggcggagggactaagctgaccgtcctaggtcagcccaaggctcgcccctgtcactctcgttcccgcctcctcacntagtagtctgagcgggctggcaaggcgcatagnnnnnnnnnnnn

SEQ ID NO: 263738 - DNA, 280 bp, Homo sapiens
  misc_feature: GYAE6OF01DLYH4.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctcgttcccaccctcctcacatagtagtctgagcgggctggcaaggcgcatagnn

SEQ ID NO: 263739 - DNA, 456 bp, Homo sapiens
  misc_feature: GYAE6OF01EQNVG.24.53.E09.1.454.CMB.1.raw
  modified_base (425)..(425): a, c, t, g, unknown or other
  misc_feature (425)..(425): n is a, c, g, or t
  modified_base (429)..(430): a, c, t, g, unknown or other
  misc_feature (429)..(430): n is a, c, g, or t
  modified_base (432)..(456): a, c, t, g, unknown or other
  misc_feature (432)..(456): n is a, c, g, or t
tcagactactatgtcacgaccggtgctcgattttagagagagtgtggttgggtttgggggctgttttggaagctgcttgtaccagagggtcaccatctcctgcactgggagcaacatcggcgcaggttttgatgtccactggtacaagctagctttccaaaaacagtcccccaaactcctcattttatcgtaacaacaatcgggccctctggggtccctgaccgattctccgctccaagtctggcacctcagcctcgctggccatcactggctccaggctgaggatgaggtgattacactgccagtcgtcgaagatgtcggcggagggactaagctgaccgtctaggtcagcccaaggctgcccctggtcactctcgttccccacctcctcacatagtagttcctgacgcgggctggacaaggcnatgnnannnnnnnnnnnnnnnnnnnnnnnnn

SEQ ID NO: 263740 - DNA, 450 bp, Homo sapiens
  misc_feature: GYAE6OF01BDKDG.24.53.E09.1.454.CMB.1.raw
  modified_base (162)..(162): a, c, t, g, unknown or other
  misc_feature (162)..(162): n is a, c, g, or t
  modified_base (438)..(450): a, c, t, g, unknown or other
  misc_feature (438)..(450): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctcaagtctggcacctcagcctcgctggccatcactgggctccaggctgaggatggagggtgattactactgccagtcgtcgaagatgttcggcggagggactaagctgaccgtcctaggtcacgcccgaaggctcgccccctggtccactctcgtccccgccctcctcactatagtagtctgacgcgggctggcaaggccgacagtagnnnnnnnnnnnnn

SEQ ID NO: 263741 - DNA, 439 bp, Homo sapiens
  misc_feature: GYAE6OF01B5Q2K.24.53.E09.1.454.CMB.1.raw
  modified_base (424)..(424): a, c, t, g, unknown or other
  misc_feature (424)..(424): n is a, c, g, or t
  modified_base (430)..(439): a, c, t, g, unknown or other
  misc_feature (430)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctgatcactctcgtccccgccctcctcacatagtactctgagcgggctggcaaggcncatagnnnnnnnnnn

SEQ ID NO: 263742 - DNA, 288 bp, Homo sapiens
  misc_feature: GYAE6OF01A3Y7I.24.53.E09.1.454.CMB.1.raw
  modified_base (273)..(273): a, c, t, g, unknown or other
  misc_feature (273)..(273): n is a, c, g, or t
  modified_base (279)..(288): a, c, t, g, unknown or other
  misc_feature (279)..(288): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcncatagnnnnnnnnnn

SEQ ID NO: 263743 - DNA, 448 bp, Homo sapiens
  misc_feature: GYAE6OF01DBKME.24.53.E09.1.454.CMB.1.raw
  modified_base (437)..(448): a, c, t, g, unknown or other
  misc_feature (437)..(448): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattcctcccgcctccaagtctggcacctcagcctcgctggccatcactgggctccaggctgaggatgagggtgattactactgccagtcgtacgaagatggttcgggcggagggactaagctgaccgtctaggtcacgcccaaggcctcgccccctggtcactctcgttccccgccctcctcacatagtgtctgagcgggctggcaaggcgacatagnnnnnnnnnnnn

SEQ ID NO: 263744 - DNA, 281 bp, Homo sapiens; identical to SEQ ID NO: 263461
  misc_feature: GYAE6OF01A93NE.24.53.E09.1.454.CMB.1.raw
  modified_base (280)..(281): a, c, t, g, unknown or other
  misc_feature (280)..(281): n is a, c, g, or t

SEQ ID NO: 263745 - DNA, 279 bp, Homo sapiens
  misc_feature: GYAE6OF01CXGSP.24.53.E09.1.454.CMB.1.raw
  modified_base (278)..(279): a, c, t, g, unknown or other
  misc_feature (278)..(279): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctgcccctcggtcactctcgttcccgccctcctcacatagtagtctgagcgggctggcaaggcgcatagnn

SEQ ID NO: 263746 - DNA, 434 bp, Homo sapiens
  misc_feature: GYAE6OF01ATLG4.24.53.E09.1.454.CMB.1.raw
  modified_base (428)..(434): a, c, t, g, unknown or other
  misc_feature (428)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtctgagcgggctggcaggcgcatagnnnnnnn

SEQ ID NO: 263747 - DNA, 280 bp, Homo sapiens; identical to SEQ ID NO: 263476
  misc_feature: GYAE6OF01EGPS5.24.53.E09.1.454.CMB.1.raw
  modified_base (280)..(280): a, c, t, g, unknown or other
  misc_feature (280)..(280): n is a, c, g, or t

SEQ ID NO: 263748 - DNA, 350 bp, Homo sapiens
  misc_feature: GYAE6OF01CIZKR.24.53.E09.1.454.CMB.1.raw
  modified_base (146)..(146): a, c, t, g, unknown or other
  misc_feature (146)..(146): n is a, c, g, or t
  modified_base (294)..(350): a, c, t, g, unknown or other
  misc_feature (294)..(350): n is a, c, g, or t
tcagactactatgtcacgaccggtgctcgatttagagagagtgtgttggggtttgggggggtgtggtggtctccactcccgccttgacggggctgctatcctgcctcgctggccatcactgggctccaggctgaggattgagggtnattactactgcctagtcgtcgaagatgttcggcggagggactaagctgaccgtcctaggtcaagcccaaggcctcgccccctggtcactctcgttccccgcctcctcacatacgtagtctgagccggctggacaagggcacgatacgnnnnnnnnnnnnnnnnnnnnnnnnnnnnnnnnnnnnnnnnnnnnnnnnnnnnnnnnn

SEQ ID NO: 263749 - DNA, 284 bp, Homo sapiens
  misc_feature: GYAE6OF01CTFGT.24.53.E09.1.454.CMB.1.raw
  modified_base (276)..(276): a, c, t, g, unknown or other
  misc_feature (276)..(276): n is a, c, g, or t
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagccaaggctcgcccctcggtcactctcgttcccaccctcctcactatacgtagtctgagcgggctggcaagggcncatagnnn

SEQ ID NO: 263750 - DNA, 440 bp, Homo sapiens
  misc_feature: GYAE6OF01CJJ7R.24.53.E09.1.454.CMB.1.raw
  modified_base (412)..(412): a, c, t, g, unknown or other
  misc_feature (412)..(412): n is a, c, g, or t
  modified_base (429)..(440): a, c, t, g, unknown or other
  misc_feature (429)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactcctcatttatcgtaacaacaatcggccctctggggtccctgaccgattctccgcctccaagtctggcacctcagcctcgctggccatcactgggctccaggctgaggatgaggtgattactactgccagtcgtcgaagatgttcggcggagggactaagctgaccgtcctaggtcagcccaaggctcgcccctcggtcactctcgtcccgcctcctcacatagtagtctgagcgggntggcaaggcgcagtagnnnnnnnnnnnn

SEQ ID NO: 263751 - DNA, 447 bp, Homo sapiens
  misc_feature: GYAE6OF01BKXYI.24.53.E09.1.454.CMB.1.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
  modified_base (430)..(447): a, c, t, g, unknown or other
  misc_feature (430)..(447): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctgctggccatcactgggctccaggctgaggatgagggtgattactactgccagtcgtcgaagatggttcggcggagggactaagctcgaccgtctaggtcagcccaaggctcgcccctggtcactctcgtcccgcctctcacatagtntctgacgcgggtctggcaaggcgacatancgnnnnnnnnnnnnnnnnnn

SEQ ID NO: 263752 - DNA, 316 bp, Homo sapiens
  misc_feature: GYAE6OF01CIDL1.24.53.E09.1.454.CMB.1.raw
  modified_base (291)..(316): a, c, t, g, unknown or other
  misc_feature (291)..(316): n is a, c, g, or t
tcagactactatgtcacgaccggtgctcgatttagagagagtgtgttggggtttggggggtgtggtggtctccactcccgccttgacggggctgcttatctgtcctcgtctggccatcactgggctccaggctgaggatgagggtgattactactgccagtcgttcgaagatgttcggacggagggactaagctgaccgtcctaggtcagcccaaggctcgcccccgtggtcacttctcgtcccacccgtcctcacatagtagtctgagcggctggctaaggcgtcatagnnnnnnnnnnnnnnnnnnnnnnnnnn

SEQ ID NO: 263753 - DNA, 439 bp, Homo sapiens
  misc_feature: GYAE6OF01CURWH.24.53.E09.1.454.CMB.1.raw
  modified_base (425)..(425): a, c, t, g, unknown or other
  misc_feature (425)..(425): n is a, c, g, or t
  modified_base (430)..(439): a, c, t, g, unknown or other
  misc_feature (430)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttcccgccctcctcactatagtagtctgacgcgggctggcaaggcncatgnnnnnnnnnn

SEQ ID NO: 263754 - DNA, 318 bp, Homo sapiens
  misc_feature: GYAE6OF01BZWO4.24.53.E09.1.454.CMB.1.raw
  modified_base (290)..(318): a, c, t, g, unknown or other
  misc_feature (290)..(318): n is a, c, g, or t
tcagactactatgtcacgaccggtgctcgatttagagagagtgtgttgggtttgggggtgtggtggtctccactcccgccttgacggggctgctatctgcctcgctggtccgatcactgggcttcccaggctgaggtatggagggtgattactactgccagtcgtcgaagatgttcgggcggagggactaagctgaccgtcctaggtcagcccaaggctcgccccctcggtcactctgttcccaccctcctcacatagtagtcctgaggcgggctggcaaggcgcatagnnnnnnnnnnnnnnnnnnnnnnnnnnnnn

SEQ ID NO: 263755 - DNA, 438 bp, Homo sapiens
  misc_feature: GYAE6OF01BCPZL.24.53.E09.1.454.CMB.1.raw
  modified_base (428)..(438): a, c, t, g, unknown or other
  misc_feature (428)..(438): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgttcccaccctcctcacatagtagtctgagcgggctggcaaggcgcatagnnnnnnnnnnn

SEQ ID NO: 263756 - DNA, 457 bp, Homo sapiens
  misc_feature: GYAE6OF01CRKP9.24.53.E09.1.454.CMB.1.raw
  modified_base (446)..(457): a, c, t, g, unknown or other
  misc_feature (446)..(457): n is a, c, g, or t
tcagactactatgtcacgaccggtgctcgatttagagagagtgtgttgagtttgggggctgtttttggaagctgcttgtaccagagggtcaccatctcctgcactggggagcaaacatcggcgcaggttttgatgtccactggtacaagcagcttacccaaaaaacacgccccccaaaactccctcaattttatacgtaaacaaacaatccggccctcgtggggtcccctgaccgattcctccgcctccaagtctggcacctcagcctcgctggccatcactgggctccaggctgaggatgagggtgattactactgccagtcgtcgaagatggttcggcggaggactaagctgaccgtctaggcagcccaaggcctcgccccctggcactctcgttccccacctcctcacatagtagtctgaggcggctggcgaaggcgcatagnnnnnnnnnnnn

SEQ ID NO: 263757 - DNA, 727 bp, Homo sapiens
  misc_feature: GYAE6OF01A35ED.24.53.E09.1.454.CMB.1.raw
  modified_base (181)..(181): a, c, t, g, unknown or other
  misc_feature (181)..(181): n is a, c, g, or t
  modified_base (328)..(328): a, c, t, g, unknown or other
  misc_feature (328)..(328): n is a, c, g, or t
  modified_base (720)..(720): a, c, t, g, unknown or other
  misc_feature (720)..(720): n is a, c, g, or t
tcagactactatgtcacgaccggtgctcgatttagagagagtgtgttagggttggggctagggttttggaaggctgcttcgtaccaggagggtcaccatctccgtgctacgtggggacgcaaccatcggcgccagggttttgacttggtccactggtacaaggccagcttaccgaaaaacncgacccccaaatcctcatttatccgtaaacaacaatccggccctctcggggtccctcgacccgtattcctccgcctcaagtctggcacctcagcctcgctcggccagtccgacgtgggcctaccgaaggcttagaggatggagggtnagttactacgtgccaggtaccgtaacgaagtactggttaccggacggtacgggtactaagccgttcgaacccgttccgtacggttaccaacggtaccccgtaaaggggacccgttaccgggccccccctttacgggttaccctaaccgtttccgttacccggtttacccccgtaaacccccgtttcccggtacctaaccgttaacggttaacggttacgtttacccgtttacggtaaccggtcccggggtacttacgggaaccgtaaaccgggccgtaccgtaacgtaacggctggtaccgatacgtagtcgactactacgtactatactacacgatagtgtacgacgtctcgtcgtactacgtcggtacggtacgacgtacgacgatacgngcgtacg

SEQ ID NO: 263758 - DNA, 284 bp, Homo sapiens
  misc_feature: GYAE6OF01EHIS4.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcggctggcaaggcgcatagnnnn

SEQ ID NO: 263759 - DNA, 451 bp, Homo sapiens
  misc_feature: GYAE6OF01AO5A3.24.53.E09.1.454.CMB.1.raw
  modified_base (436)..(451): a, c, t, g, unknown or other
  misc_feature (436)..(451): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcgggcggagggactaagctcgaccgtccgtaggtcacgcccaaggctcgccccctggtcactctcgttccccgccctcctcacatagtagtctggagcgggctggcaaggcgcagtagnnnnnnnnnnnnnnnn

SEQ ID NO: 263760 - DNA, 554 bp, Homo sapiens
  misc_feature: GYAE6OF01B5EVO.24.53.E09.1.454.CMB.1.raw
  modified_base (475)..(475): a, c, t, g, unknown or other
  misc_feature (475)..(475): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaaacttaccttcagctagttcggggccagggccacccgtcggtccaccgtcctcctcacgccctccaccgaacggccctagtcccggtcccttcccccgtcggcccgcccgtcgcctccgacggcnccgaccctccgacgacgccacgcgccgcccgtggcctcgcctggcaaggtacctaccgtccactatacgtagtcgtagg

SEQ ID NO: 263761 - DNA, 283 bp, Homo sapiens
  misc_feature: GYAE6OF01AXH8S.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnn

SEQ ID NO: 263762 - DNA, 714 bp, Homo sapiens
  misc_feature: GYAE6OF01EO1K1.24.53.E09.1.454.CMB.1.raw
  modified_base (221)..(221): a, c, t, g, unknown or other
  misc_feature (221)..(221): n is a, c, g, or t
tcagactactatgtcacgaccggtgctcgatttagagagagtgtgttgggtttggggaggcttggtccagcctggggggtccctgagactctcctgtgcagcctctggattcccctttagtgtactttttggatgacctgggtccgccaggctccgagggacgggctggagtgggtggccaatataaggcacgatggacgtagcatgtactatgtggactntgtgaaggccattcacatctcagagacacgcccagaactcactgtatctaggaaatgaccagcctgagagtcgaggacacggctatgtattactgtgcgaccatatcagcacctggacgtcgacatctagaacttaccttccgagtctagtttcggggacccaggggtccctacccgttcgggtccctacccggttctcccttaccacgtcccctacccgacccgaaaccggggcccctacggttcccggttcccctttccccccgtcgggtccccgtcccccgtacggccctaccccggaaggggtacccgacccgtaaccccgtacccggaacggaccgacccgaaccgaacgggccccgggtcccccggtcggggtaccgtcccgggttaccccggttaggggttacccgtaaaaccgggtacccctttaaccccgtttaaccccgaaaccgttaaccgtttaacgggttaccgttccggttaaccgggg

SEQ ID NO: 263763 - DNA, 281 bp, Homo sapiens
  misc_feature: GYAE6OF01EFZHV.24.53.E09.1.454.CMB.1.raw
  modified_base (270)..(270): a, c, t, g, unknown or other
  misc_feature (270)..(270): n is a, c, g, or t
  modified_base (276)..(281): a, c, t, g, unknown or other
  misc_feature (276)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgcccctggtcactctgttccacctcctcacatagtagtctgagcgggctggcaaggcncatagnnnnnn

SEQ ID NO: 263764 - DNA, 780 bp, Homo sapiens
  misc_feature: GYAE6OF01C9REY.24.53.E09.1.454.CMB.1.raw
  modified_base (172)..(172): a, c, t, g, unknown or other
  misc_feature (172)..(172): n is a, c, g, or t
  modified_base (701)..(701): a, c, t, g, unknown or other
  misc_feature (701)..(701): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (748)..(748): a, c, t, g, unknown or other
  misc_feature (748)..(748): n is a, c, g, or t
  modified_base (758)..(758): a, c, t, g, unknown or other
  misc_feature (758)..(758): n is a, c, g, or t
  modified_base (764)..(764): a, c, t, g, unknown or other
  misc_feature (764)..(764): n is a, c, g, or t
  modified_base (768)..(768): a, c, t, g, unknown or other
  misc_feature (768)..(768): n is a, c, g, or t
  modified_base (770)..(770): a, c, t, g, unknown or other
  misc_feature (770)..(770): n is a, c, g, or t
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
  modified_base (778)..(778): a, c, t, g, unknown or other
  misc_feature (778)..(778): n is a, c, g, or t
tcagactactatgtcacgaccggtgctcgatttagagagagtgtgttgggtttggggctgtttttggagcgtgcttgtaccagagggtcaccgatctcctggcactgggagcaacgatcgggccgcaggttttggatggtccacgtggtaccaagcagccttaccaaaaacncgcccccaaatcctcatttactcgtaaacaacaagtcggtcccttcgttcggggtccctgaccggacttcctcccgccttaccgaaggtccgtcggaccaaccttcgaacgtccgtcggtccttaggccctaattccgtaacggttcgggggaccctttacccgaaggggtccttagggaaccgggtaacgtttcgggaacgggggttagtaaactttttaaccgaaacgtttccggaaccccgttaaaggtttccggttaaccggtaaaaggttacggtttccgggtttaaccggggacccgggtaaaaggggtaaccctttaaaaggtccgtttaaccggtaaccccggttaccgtaagggttccgaacggtaccccgttaaagggcccttccggaccccccgtgggttacctaacgtccgtttaccggttcccctaaccctccgtagtaaccgaagttacggtacgtcggtacggtaacggtcgggtacgttcgggtacggaaacgggttccaacgttaagtacgngttcgacgtgcggcacgtccgaggccgagtcaggctcacgtcncncncacgcgcgancgcgcncgcncncncncngngc

SEQ ID NO: 263765 - DNA, 441 bp, Homo sapiens
  misc_feature: GYAE6OF01B3U4O.24.53.E09.1.454.CMB.1.raw
  modified_base (430)..(441): a, c, t, g, unknown or other
  misc_feature (430)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggcccatcactgggctccaggctgaggatgagggtgattactactgccagtcgtcgaagatgttcggcggagggactaagctgaccgtcctaggtcagcccaaggctgccccctggtcactctcgttcccaccctcctcacatagtagtctgagcgggctggcaaggcgcatagnnnnnnnnnnnn

SEQ ID NO: 263766 - DNA, 438 bp, Homo sapiens
  misc_feature: GYAE6OF01DH4M8.24.53.E09.1.454.CMB.1.raw
  modified_base (431)..(438): a, c, t, g, unknown or other
  misc_feature (431)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattcctccgcctccaagtctggcacctcagcctcgctggccatcactgggctcaggctgaggatgagggtgattactactgccagtcgtcgaagatggttcggcggagggactaagctgaccgtctagtcagcccaaggctcgcccctggtcactctcgttcccaccctctcactatagtacgtctggagcgggctcggacaaggcgcatacgnnnnnnnn

SEQ ID NO: 263767 - DNA, 436 bp, Homo sapiens
  misc_feature: GYAE6OF01ARAAZ.24.53.E09.1.454.CMB.1.raw
  modified_base (161)..(161): a, c, t, g, unknown or other
  misc_feature (161)..(161): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (430)..(436): a, c, t, g, unknown or other
  misc_feature (430)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaaacaacaatcggccctctggggtccctgaccgattctccgcctccaagtctggcacctcagcctcgctggccatcactgggctccaggctgaggatgagggtnattactactgccaggtcgtcgaagngtgtcggcggagggactaagctgaccgtcctaggtcagcccaaggctcgcccctggtcactctcgtcccaccctcctcacatagtagtcnggacgcgggctggacaaggcncatgnnnnnnn

SEQ ID NO: 263768 - DNA, 281 bp, Homo sapiens; identical to SEQ ID NO: 263535
  misc_feature: GYAE6OF01CVQ65.24.53.E09.1.454.CMB.1.raw
  modified_base (279)..(281): a, c, t, g, unknown or other
  misc_feature (279)..(281): n is a, c, g, or t

SEQ ID NO: 263769 - DNA, 568 bp, Homo sapiens
  misc_feature: GYAE6OF01BWA0N.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcagttcggggccagggcacccgtgtcacccgtctcctcacgcctccaccaacgggcccacgtccggttccttcccccgtcggcccgccctcgcctccgacggcgaccaccctccgacgacgacaccgacgccggcccgtcgggcctcggcccgtgggtaccgaaacgggaccttaaccttcccaactagttaagtcggtcgtacggg

SEQ ID NO: 263770 - DNA, 534 bp, Homo sapiens
  misc_feature: GYAE6OF01AUQJ3.24.53.E09.1.454.CMB.1.raw
  modified_base (167)..(167): a, c, t, g, unknown or other
  misc_feature (167)..(167): n is a, c, g, or t
  modified_base (189)..(189): a, c, t, g, unknown or other
  misc_feature (189)..(189): n is a, c, g, or t
  modified_base (298)..(298): a, c, t, g, unknown or other
  misc_feature (298)..(298): n is a, c, g, or t
  modified_base (379)..(379): a, c, t, g, unknown or other
  misc_feature (379)..(379): n is a, c, g, or t
  modified_base (481)..(489): a, c, t, g, unknown or other
  misc_feature (481)..(489): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(506): a, c, t, g, unknown or other
  misc_feature (504)..(506): n is a, c, g, or t
  modified_base (510)..(510): a, c, t, g, unknown or other
  misc_feature (510)..(510): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (531)..(533): a, c, t, g, unknown or other
  misc_feature (531)..(533): n is a, c, g, or t
tcagactactatgtcacgaccggtgctcgatttagagagagtgtgttgggtttgggggctgtttttggggaagctgcttgtaccagagggtcaccgatctcctgcactgggagcaacatcggcgcaggttttgatgtccactggtacaagcagcttcccaaaaacgngccccccaaactcctcatttancgtaacaacaatcggccctctggggtccctgaccgattctccgcctccaagtcctggccacctcagcctcggctggccatcactgggctccaggctgaggatgagggtnattactactgccagtcgtacgaagatggttcggtcggagggactaaggctaggacccgtcctagggtcacgcccgaagtcncgtccccctggtccattcctcggttcccccacccttccctacaccacgttacgtagtcctggacggccggggcttcgggacaacgggccgcgaagttacggnnnnnnnnntnntntntntntntnnngcgngcnncncncncacncacancnnnc

SEQ ID NO: 263771 - DNA, 499 bp, Homo sapiens
  misc_feature: GYAE6OF01CT4DY.24.53.E09.1.454.CMB.1.raw
  modified_base (163)..(163): a, c, t, g, unknown or other
  misc_feature (163)..(163): n is a, c, g, or t
  modified_base (393)..(393): a, c, t, g, unknown or other
  misc_feature (393)..(393): n is a, c, g, or t
  modified_base (489)..(499): a, c, t, g, unknown or other
  misc_feature (489)..(499): n is a, c, g, or t
tcagactactatgtcacgaccggtgctcgatttagagagagtgtgttgggtttgggggctgttttggaagctgcttgtaccagagggtcaccatctcctgcactgggagcaacatcggcgctaggttttgatgtccactggtacaagcagcttaccaaaaacncgacccccaaactcctcatttatacgtaaacaacaatccggccctcgtcggggtccctgaccgtattcctccgcctccaagtctggccacctcacgcctcgctggccatccacgtgggcctccaggctgaggatggaggtgattactactcgaccagtcgtacgaagagttggttcgggcgggagggtaactaagcgtacgaccgtccgtaggtcacgcccgaaggtccncgtcccccgtggtccactccttcgttccccaccctcctacactagtacgtacgtcgtcggacggccgggacgtcggacgaacgggcgactagaggnnnnnnnnnnn

SEQ ID NO: 263772 - DNA, 394 bp, Homo sapiens
  misc_feature: GYAE6OF01A13N0.24.53.E09.1.454.CMB.1.raw
  modified_base (386)..(386): a, c, t, g, unknown or other
  misc_feature (386)..(386): n is a, c, g, or t
  modified_base (390)..(394): a, c, t, g, unknown or other
  misc_feature (390)..(394): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggctgactattattgctgctcatatgcaggcaactccggatctgtcttcgggactggggaccatggtcaccgtcctcggtcagcccaaggcccaaccccactgtcactctcgttcccgccctcctcacatagtgtctgagcggctggcaaggcnatgnnnnn

SEQ ID NO: 263773 - DNA, 283 bp, Homo sapiens
  misc_feature: GYAE6OF01BTSW9.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtgattactactgccagtcgtcgaagatgttcggcggagggactaagctgaccgtcctaggtcagcccaaggcctcgccccctcggtcactctcgttccccaccctcctcacatagtagtctgagcgggctggcaaggcgcatagnn

SEQ ID NO: 263774 - DNA, 430 bp, Homo sapiens
  misc_feature: GYAE6OF01EGG8K.24.53.E09.1.454.CMB.1.raw
  modified_base (161)..(161): a, c, t, g, unknown or other
  misc_feature (161)..(161): n is a, c, g, or t
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (424)..(430): a, c, t, g, unknown or other
  misc_feature (424)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggntgagggtgattactactgccagtcgtcgaagntgtcggcggagggactaagctgaccgtctaggtcagcccaaggctcgcccctggtcactctcgttcccgccctctcacatagtagtctgagcgggctggcaggcgcatagnnnnnnn

SEQ ID NO: 263775 - DNA, 442 bp, Homo sapiens
  misc_feature: GYAE6OF01ALHUJ.24.53.E09.1.454.CMB.1.raw
  modified_base (162)..(162): a, c, t, g, unknown or other
  misc_feature (162)..(162): n is a, c, g, or t
  modified_base (432)..(442): a, c, t, g, unknown or other
  misc_feature (432)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtctaggtcagcccaaggctcgccccctggtcactctcgtcccaccctcctcacatagtacgtctggagcgggctgggcaagggcgcatagcnnnnnnnnnnn

SEQ ID NO: 263776 - DNA, 279 bp, Homo sapiens
  misc_feature: GYAE6OF01B0F8C.24.53.E09.1.454.CMB.1.raw
  modified_base (273)..(279): a, c, t, g, unknown or other
  misc_feature (273)..(279): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgaggtgattactactgccagtcgtcgaagatgttcggcggaggactaagctgaccgtctaggtcagcccaaggctgccccctggtcactctgttcccacctctcacatagtagtctgagcgggctggcaaggcgcatagnnnnnnn

SEQ ID NO: 263777 - DNA, 284 bp, Homo sapiens
  misc_feature: GYAE6OF01CED33.24.53.E09.1.454.CMB.1.raw
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacatagtagtctgagcgggctggcaaggcgcatagnnn

SEQ ID NO: 263778 - DNA, 449 bp, Homo sapiens
  misc_feature: GYAE6OF01BOPF2.24.53.E09.1.454.CMB.1.raw
  modified_base (163)..(163): a, c, t, g, unknown or other
  misc_feature (163)..(163): n is a, c, g, or t
  modified_base (432)..(449): a, c, t, g, unknown or other
  misc_feature (432)..(449): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaacaacaatcggccctctggggtccctgaccgattctccgcctccaagtctggcacctcagcctcgctggccatcactggctccaggctgagatgaggtgattactactgccagtcgtcgaagatgttcggcggaggactaagctgaccgtctaggtcagcccaaggctcgcccctggtcactctcgttccccaccctcctcacatagtacgtctgacgcgggtctggctaacgggcgcatagnnnnnnnnnnnnnnnnnn

SEQ ID NO: 263779 - DNA, 431 bp, Homo sapiens
  misc_feature: GYAE6OF01BENTD.24.53.E09.1.454.CMB.1.raw
  modified_base (160)..(160): a, c, t, g, unknown or other
  misc_feature (160)..(160): n is a, c, g, or t
  modified_base (425)..(431): a, c, t, g, unknown or other
  misc_feature (425)..(431): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctcgttcccaccctcctcacatagtagtctgagcgggctggcaaggcgcatagnnnnnnn

SEQ ID NO: 263780 - DNA, 457 bp, Homo sapiens
  misc_feature: GYAE6OF01DRTBC.24.53.E09.1.454.CMB.1.raw
  modified_base (160)..(160): a, c, t, g, unknown or other
  misc_feature (160)..(160): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
  modified_base (432)..(457): a, c, t, g, unknown or other
  misc_feature (432)..(457): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttccaaaaacngcccccaaactcctcatttatcgtaacaacaatcggccctcgtcggggtccctgaccgattcctccgcctccaagtctggccacctcagcctcgctggccatcactgggctccaggctgaggatgaggtnattactactcgccagtcgtacgaagnttgtcggnggaggactaagctgaccgtctaggtcagccaaggctcgcccctgtcnctcncgttcccacctctcactatacgtagtctgacggcggntcggacgaaggccgcagtgnnnnnnnnnnnnnnnnnnnnnnnnnn

SEQ ID NO: 263781 - DNA, 299 bp, Homo sapiens
  misc_feature: GYAE6OF01CT2NA.24.53.E09.1.454.CMB.1.raw
  modified_base (287)..(287): a, c, t, g, unknown or other
  misc_feature (287)..(287): n is a, c, g, or t
  modified_base (291)..(299): a, c, t, g, unknown or other
  misc_feature (291)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaggcctcgcccctcggtcactctcgttcccgccctcctcacatagtagtctggaggcgggctggacaaggcgaaaaacntagnnnnnnnnn

SEQ ID NO: 263782 - DNA, 437 bp, Homo sapiens
  misc_feature: GYAE6OF01ENKZU.24.53.E09.1.454.CMB.1.raw
  modified_base (322)..(322): a, c, t, g, unknown or other
  misc_feature (322)..(322): n is a, c, g, or t
  modified_base (423)..(423): a, c, t, g, unknown or other
  misc_feature (423)..(423): n is a, c, g, or t
  modified_base (429)..(437): a, c, t, g, unknown or other
  misc_feature (429)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcattttatcgtaacaacaatcggccctctggggtccctgaccgattctcgcctccaagtctggcacctcagcctcgctggccatcactgggctccaggctgaggatgagggtgattactactgccagtcgtcgaagatgttcggnggaggactaagctgaccgtctaggtcacgcccaaggcctcgccccctcggtcactctcgtcccaccctcctcacatagtgtctgagcgggctggcaaggcncatagnnnnnnnnn

SEQ ID NO: 263783 - DNA, 597 bp, Homo sapiens
  misc_feature: GYAE6OF01BY8E2.24.53.E09.1.454.CMB.1.raw
  modified_base (250)..(250): a, c, t, g, unknown or other
  misc_feature (250)..(250): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagactactatgtcacgaccggtgctcgatttagagagagtgtgttgggtttgggaggcttggtccagcctggggggtccctgagactctcctgtgcagcctctggacttccccttttagtgtactttttggatgacctgggtccgccaggctccgagggacggggctggagtgggtggccaatataaggcacgatggacgtagcatgtactatgtggactctgtgaagggccattcacatctccaganacaacgcccagaactcactgtatctagaaatgaccagcctgagagtcgaggacacggctatgtattactgtgcgaccatatcagcaccgtggacgtcgcatctagaaacttcttccgagctagttcggggccagggccacccgtgtccaccgtctcctcacgtccctccgaaccaacggccctacgtccgtcccgttccccncggtcccgccctcgcctccgacggacnccgtaccctccggacgtcgaccacgtacggccggtcccggtcgggccgtcggtcccttcgggtacgaaaccgggtaccttaacccttacccaacgtaacgttacgtacgtcgtacggg

SEQ ID NO: 263784 - DNA, 291 bp, Homo sapiens
  misc_feature: GYAE6OF01CN5O2.24.53.E09.1.454.CMB.1.raw
  modified_base (281)..(291): a, c, t, g, unknown or other
  misc_feature (281)..(291): n is a, c, g, or t
tcagactactatgtcacgaccggtgctcgatttagagagagtgtgttgggtttgggggtgtggtggtctccactcccgccttggacggggctgctatctgcctcgctggccatcactgggctccaggctgaggatggaggtgattactactgccagtcgtcgaagatgtcggcggagggactaagctgaccgtctaggcagcccaaggctcgcccctggtcactctcgttcccacctcctcactatagtagtctggagcgggctgggcaaggcgacatagnnnnnnnnnnn

SEQ ID NO: 263785 - DNA, 571 bp, Homo sapiens
  misc_feature: GYAE6OF01BHJN7.24.53.E09.1.454.CMB.1.raw
tcagactactatgtcacgaccggtgctcgatttagagagagtgtgttgggtttgggaggcttggtccagcctggggggtccctgagactctcctgtgcagcctctggacttcccctttagtgtactttttggatgacctgggtccgccaggctccgagggacggggctggagtgggtggccaatataaggcacgatggacgtagcatgtactatgtggactctgtgaagggccattcaccatctccagagacaacgcccagaactcactgtatctggaaatgaccagcctgagagtcgaggacacggctatgtattactgtgcgaccatatcagcacctggactcgcatctagaacttacttccagctagttcggggccagggccacccgtggtccaccgtcctcctcacgcctccaccgaacggcccagtccggtcccttcccccgtggcccgccctcgcctccgaggacgcctacccgtccgagcgcaccgacgccggcccgtgggcctcggtcccgtacggtcaacgggtacccttaccgttacccacaagttacgtgttcgtacggg

SEQ ID NO: 263786 - DNA, 443 bp, Homo sapiens
  misc_feature: GYAE6OF01EYB4H.24.53.E09.1.454.CMB.1.raw
  modified_base (162)..(162): a, c, t, g, unknown or other
  misc_feature (162)..(162): n is a, c, g, or t
  modified_base (293)..(293): a, c, t, g, unknown or other
  misc_feature (293)..(293): n is a, c, g, or t
  modified_base (431)..(443): a, c, t, g, unknown or other
  misc_feature (431)..(443): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaactcctcatttatcgtaaacaacaatcggccctctggggtccctgaccgattctccgcctccaagtctggcacctcagcctcgctggccatcactgggctccaggctgaggatggagggtnattactactgccagtcgtcgaagatgttcggcggaggactaagctgaccgtctaggcacgcccaaggcctcgcccctggtcactctcgtccccacctcctcacatagtacgtctgagcgggctggacaggcacatagnnnnnnnnnnnnn

SEQ ID NO: 263787 - DNA, 890 bp, Homo sapiens
  misc_feature: GYAE6OF01CT4I3.24.53.E09.1.454.CMB.1.raw
  modified_base (164)..(164): a, c, t, g, unknown or other
  misc_feature (164)..(164): n is a, c, g, or t
  modified_base (858)..(858): a, c, t, g, unknown or other
  misc_feature (858)..(858): n is a, c, g, or t
  modified_base (861)..(890): a, c, t, g, unknown or other
  misc_feature (861)..(890): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgcaggttttgatgtccactggtacaagcagcttaccaaaaaacncgaccccccaaaactcctactaattttactaccgtaaaaccaaacaaacgttcccgggcccccttcgttcggggggtcccccttaggaacccgtatttcccgtccccggaccctacccaaaggttcctacgggaccctaacccttccaacggtccccttcggcccgttcgggacccctaacttccgaaccgtttcggggggccccttaccccggaaggggtccttaggggaaacggggtaaggttcggggaaacggggggtttattaaacctttttaacccgtaaccggtttccgggaccccgttaaacggggtttaccgggttaaccgggaaaaaggttacgtttccgggggttttacccggggggacggggtaaaacgggggtaaaccctttaaaaacgggcccggttaacccgggtaaacccccgggtttacccggttaaacgggggttccccaaaacccgggtacccccccgggaaaagggggttccccccttaccccgggtccccccccccggtttacgggttaccccctaaccgttttcccccgtttacccggtttacccccccctaaccccccctttcccgtaaccctaaaccgttaagtttaacggttaaccggttaccgtacggggaaccgggtccgggggtcccgtacggggaaccggtaaacgggcccgacgtaagtaacggncgnnnnnnnnnnnnnnnnnnnnnnnnnnnnnn

SEQ ID NO: 263788 - DNA, 278 bp, Homo sapiens
  misc_feature: GYAE6OF01C46UL.24.53.E09.1.454.CMB.1.raw
  modified_base (277)..(278): a, c, t, g, unknown or other
  misc_feature (277)..(278): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgcccctggtcactctgttcccacctcctcacatagtagtctgagcgggctggcaaggcgcatagnn

SEQ ID NO: 263789 - DNA, 288 bp, Homo sapiens
  misc_feature: GYAE6OF01BHGDD.24.53.E09.1.454.CMB.1.raw
  modified_base (281)..(288): a, c, t, g, unknown or other
  misc_feature (281)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnnnnn

SEQ ID NO: 263790 - DNA, 284 bp, Homo sapiens
  misc_feature: GYAE6OF01CN963.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccgccctcctcacatagtagtctgagcgggctggcaaggcgcatagnnnn

SEQ ID NO: 263791 - DNA, 284 bp, Homo sapiens
  misc_feature: GYAE6OF01A6CYU.24.53.E09.1.454.CMB.1.raw
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctgggcaaggcgcatagnnn

SEQ ID NO: 263792 - DNA, 439 bp, Homo sapiens
  misc_feature: GYAE6OF01AGT9E.24.53.E09.1.454.CMB.1.raw
  modified_base (429)..(439): a, c, t, g, unknown or other
  misc_feature (429)..(439): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctcggtcactctcgttcccaccctcctcacatagtagtctgacgcgggctggcaaggcgcatagnnnnnnnnnnn

SEQ ID NO: 263793 - DNA, 521 bp, Homo sapiens
  misc_feature: GYAE6OF01DP51R.24.53.E09.1.454.CMB.1.raw
  modified_base (163)..(163): a, c, t, g, unknown or other
  misc_feature (163)..(163): n is a, c, g, or t
  modified_base (431)..(431): a, c, t, g, unknown or other
  misc_feature (431)..(431): n is a, c, g, or t
  modified_base (504)..(504): a, c, t, g, unknown or other
  misc_feature (504)..(504): n is a, c, g, or t
  modified_base (511)..(521): a, c, t, g, unknown or other
  misc_feature (511)..(521): n is a, c, g, or t
tcagactactatgtcacgaccggtgctcgatttagagagagtgtgttgggtttgggggctgttttggaagctgcttgtaccagagggtcaccatctcctgcactgggagcaacatcggcgctaggttttgatgtccactggtacaagcagcttaccaaaaacncgaccccccaaaactcctctattttatcgtaaacaacaatccggccctcgtcggggtccctgaccgtattcctccgcctccaagtctggccacctcagcctcgtcctggccctatccacgttggacctccgaggctgaggatgaggctagacttattatgctgctcatatgctaggcaacgtcgatcgtcgttcgttcggactgggacctagtcggtacctacccgtcgttcggtacaacgaccccgaaacggccccaaacccccgtntcggtccacttccgtaccgttcccccgccttccctcactagttagtacgtcgtagacggcggctgggcaagcncgaatgnnnnnnnnnnn

SEQ ID NO: 263794 - DNA, 136 bp, Homo sapiens
  misc_feature: GYAE6OF01CHI3S.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgg

SEQ ID NO: 263795 - DNA, 282 bp, Homo sapiens
  misc_feature: GYAE6OF01AH5U1.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatatagtctgagcgggctggcaaggcgcatagnnnn

SEQ ID NO: 263796 - DNA, 521 bp, Homo sapiens
  misc_feature: GYAE6OF01A47NO.24.53.E09.1.454.CMB.1.raw
  modified_base (170)..(170): a, c, t, g, unknown or other
  misc_feature (170)..(170): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (463)..(464): a, c, t, g, unknown or other
  misc_feature (463)..(464): n is a, c, g, or t
  modified_base (482)..(482): a, c, t, g, unknown or other
  misc_feature (482)..(482): n is a, c, g, or t
  modified_base (486)..(490): a, c, t, g, unknown or other
  misc_feature (486)..(490): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
tcagactactatgtcacgaccggtgctcgatttagagagagtgtgttgggtttggggcgtgttttggaagctgcttgtaccagagggtcacctatctcctgcactgggagcaacatcggcgcaggttttgactgtccacgttgggtacaagcaggtccttaccaaaaacncgccccctaaaatcctcatttatcgtaacaacatccggccctgtggggtccctgaccggattcctccgcctcaagtcgtggccacctcagcctcgctggccatccactgggcctccaggtcagaggatgagggtnacttactacgtgccaggtccgtacgaagngtggttcggngggagggactaagcctggtaccgttctaggtcacggcccgaaggtctcgcccctggtcactctcgtcccgcctcnactntatcgtctgacgcggctcggacaaggcacatagntnntgnntcgatcactgtcagtcgnacgnnnnngagngagacgcgngngcgtcacntcngtgcg

SEQ ID NO: 263797 - DNA, 439 bp, Homo sapiens
  misc_feature: GYAE6OF01E24IP.24.53.E09.1.454.CMB.1.raw
  modified_base (430)..(439): a, c, t, g, unknown or other
  misc_feature (430)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtctcgaagatgttcggcggagggactaagctgaccgtcctaggtcagcccaaggctcgccccctggtcactctcgttccccgccctcctcacatagtagtctgacgcgggctggcaaggcgcatagnnnnnnnnnn

SEQ ID NO: 263798 - DNA, 460 bp, Homo sapiens
  misc_feature: GYAE6OF01CLOND.24.53.E09.1.454.CMB.1.raw
  modified_base (163)..(163): a, c, t, g, unknown or other
  misc_feature (163)..(163): n is a, c, g, or t
  modified_base (447)..(460): a, c, t, g, unknown or other
  misc_feature (447)..(460): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaacaacaatcggccctcgtggggtcccctgaccgattctcccgcctccaagtctggcacctcagcctcgctggccatccactgggcctccaggctgaggatggagggtgattactactgccagtcgtcgaagatgttcggcggagggactaagctgaccgtcctaggtcagcccaaggctcgccccctggtcactcgtcgttccccaccctcctcacatagtacgtctgaggcgggctgggcgaagggccgcaagtagnnnnnnnnnnnnnn

SEQ ID NO: 263799 - DNA, 284 bp, Homo sapiens
  misc_feature: GYAE6OF01EJIOO.24.53.E09.1.454.CMB.1.raw
  modified_base (283)..(284): a, c, t, g, unknown or other
  misc_feature (283)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtagtctgagcgggctggcaaggcgcatagnn

SEQ ID NO: 263800 - DNA, 441 bp, Homo sapiens
  misc_feature: GYAE6OF01CHSAK.24.53.E09.1.454.CMB.1.raw
  modified_base (427)..(427): a, c, t, g, unknown or other
  misc_feature (427)..(427): n is a, c, g, or t
  modified_base (432)..(441): a, c, t, g, unknown or other
  misc_feature (432)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtcactcgtcgtccccgccctcctcacatagtagtctgaggcgggctggacaaggcgnatagnnnnnnnnnn

SEQ ID NO: 263801 - DNA, 600 bp, Homo sapiens
  misc_feature: GYAE6OF01AX10X.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacgggctggagtgggtgccaatataaggcacgatggacgtagcatgtactatgtggactctgtgaagggccgattccaccatctccagagacaacgcccagaactcactgtatctggaaatgaccagcctgagagtcgaggacacggctatgtattactgtgcgaccatatcagcacctggatcgcatctgaactcttccagcagttggggccagggccacccgtggtccacccgtctccctcacgccctccaccaacgggcccccagttcccgggtccctttccccccgtcgggtccccgcccctgccctcccgagggaccgccacccgtcccgacgacgccaaccgacggcccggccccgtcggggcctcggcccgttcgggtacccaaacgggtacccttacccgttcccaaccgtaagttacggttagttccgtacggg

SEQ ID NO: 263802 - DNA, 284 bp, Homo sapiens
  misc_feature: GYAE6OF01C2X67.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaggctcgccccctcggtcactctcgttcccaccctcctcacatagtagtctgagcgggctggcaaggcgcatagnnnn

SEQ ID NO: 263803 - DNA, 284 bp, Homo sapiens
  misc_feature: GYAE6OF01EBUXG.24.53.E09.1.454.CMB.1.raw
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacggggctgctatctgtctcgctggccatcactgggctccaggctgaggatgagggtgattactactgccagtcgtcgaagatgttcggcggagggactaagctgaccgtcctaggtcagcccaaggctcgccccctcggtcactctcgttcccaccctcctcacatagtagtctgagcgggctggcaaggcgcatagnnn

SEQ ID NO: 263804 - DNA, 280 bp, Homo sapiens; identical to SEQ ID NO: 263563
  misc_feature: GYAE6OF01DL20G.24.53.E09.1.454.CMB.1.raw
  modified_base (279)..(280): a, c, t, g, unknown or other
  misc_feature (279)..(280): n is a, c, g, or t

SEQ ID NO: 263805 - DNA, 283 bp, Homo sapiens
  misc_feature: GYAE6OF01C11HV.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctcggtcactctcgttcccgccctcctcacatagtagtctgagcgggctggcaaggcgcatagnnnn

SEQ ID NO: 263806 - DNA, 476 bp, Homo sapiens
  misc_feature: GYAE6OF01DXJYA.24.53.E09.1.454.CMB.1.raw
  modified_base (188)..(188): a, c, t, g, unknown or other
  misc_feature (188)..(188): n is a, c, g, or t
  modified_base (300)..(300): a, c, t, g, unknown or other
  misc_feature (300)..(300): n is a, c, g, or t
  modified_base (463)..(476): a, c, t, g, unknown or other
  misc_feature (463)..(476): n is a, c, g, or t
tcagactactatgtcacgaccggtgctcgatttagagagagtgtgttgagtttgggggctgtttttggaagctgcttgtaccagagggtcaccatctcctgcactggggagcaacatcggcgcaggttttgatgtccactggtacaagcagcttaccaaaaaacacgcccccaaaactcctcatttancgtaaacaacaatcggccctctcggggtccctgaccgattcctccgcctccaagtctggcacctcacgcctcgctggccatcactgggctccgaggctgaggatggagggtnattactactgccagtcgtacgaagatggttcggcggagggactaagctgaccgtcgtaggtcacgcccgaaggcctcgccccctggtcacttctccgttccccaccctcctcactacttacgtacgtcgtgacggcggcgtcggacgaacgggcacgatagcnnnnnnnnnnnnnn

SEQ ID NO: 263807 - DNA, 497 bp, Homo sapiens
  misc_feature: GYAE6OF01CWZEF.24.53.E09.1.454.CMB.1.raw
  modified_base (162)..(162): a, c, t, g, unknown or other
  misc_feature (162)..(162): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (465)..(465): a, c, t, g, unknown or other
  misc_feature (465)..(465): n is a, c, g, or t
  modified_base (468)..(497): a, c, t, g, unknown or other
  misc_feature (468)..(497): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagccagcttaccaaaaacncgccccccaaatccctcatttatccgtaaacaacaatccggccctcgtcggggtcccctgaccgattcctcccgcctccaagtcctggccacctcagcctcgctggccatcacgtggcctcaggctgaggatggaggtgtaattactactcgccagtcgacgaagnttggtcgggnggaggactaagctcggaccgttcgtaggtcacgacccgaaggcctcgcccccgtgtccacttcctccgttcccaccctccacactatagtacgtctagacgcgggctggacaacgggcgacagtagncgnnnnnnnnnnnnnnnnnnnnnnnnnnnnnn

SEQ ID NO: 263808 - DNA, 444 bp, Homo sapiens
  misc_feature: GYAE6OF01C5725.24.53.E09.1.454.CMB.1.raw
  modified_base (433)..(444): a, c, t, g, unknown or other
  misc_feature (433)..(444): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtcccctgaccgattctcccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctggccactctcgttcccaccctcctcacatagtacgtctcgagcgggctgggcaaggcgcatacgnnnnnnnnnnnn

SEQ ID NO: 263809 - DNA, 439 bp, Homo sapiens
  misc_feature: GYAE6OF01DPVKD.24.53.E09.1.454.CMB.1.raw
  modified_base (377)..(377): a, c, t, g, unknown or other
  misc_feature (377)..(377): n is a, c, g, or t
  modified_base (428)..(439): a, c, t, g, unknown or other
  misc_feature (428)..(439): n is a, c, g, or t
tcagactactatgtcacgaccggtgctcgatttagagagagtgtgttgggtttgggggctgttttggaagctgcttgtacagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtccactcngttcccaccctcctcacatagtagtctgaggcggctggcaaggcgcatagnnnnnnnnnnnn

SEQ ID NO: 263810 - DNA, 434 bp, Homo sapiens
  misc_feature: GYAE6OF01CKORJ.24.53.E09.1.454.CMB.1.raw
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtgattactactgccagtcgtcgaagtatgttcggcggaggactaagctgaccgtctaggtcagccaagctcgcccctggtcactctcgttcccgcctccncactatagtagtctgagcgggctggcaaggcncatagnnnnnnnnn

SEQ ID NO: 263811 - DNA, 438 bp, Homo sapiens
  misc_feature: GYAE6OF01CIBRI.24.53.E09.1.454.CMB.1.raw
  modified_base (288)..(288): a, c, t, g, unknown or other
  misc_feature (288)..(288): n is a, c, g, or t
  modified_base (428)..(438): a, c, t, g, unknown or other
  misc_feature (428)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggtnattactactgccagtcgtcgaagatggtcggcggaggactaagctgaccgtctaggtccagcccaaggcctcgccccctggtcactctcgttccccgccctcctcacatagtagtctgagcgggctggcaaggcacatgnnnnnnnnnnn

SEQ ID NO: 263812 - DNA, 436 bp, Homo sapiens
  misc_feature: GYAE6OF01DUU7Y.24.53.E09.1.454.CMB.1.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (429)..(436): a, c, t, g, unknown or other
  misc_feature (429)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaatcctcatttatcgtaacaacaatcggccctctggggtccctgaccgattctccgcctccaagtctggcacctcagcctcgctggccatcatgggctccaggctgaggatgagggtnattactactgccagtcgtcgaagntgttcggcggagggactaagctgaccgtctaggtcagcccaaggctcgccccctggtccactctcgttccccaccctcctcacatagtagtctgagcgggctggcaaggccgcatagnnnnnnnn

SEQ ID NO: 263813 - DNA, 530 bp, Homo sapiens
  misc_feature: GYAE6OF01A8AL1.24.53.E09.1.454.CMB.1.raw
  modified_base (301)..(301): a, c, t, g, unknown or other
  misc_feature (301)..(301): n is a, c, g, or t
  modified_base (513)..(530): a, c, t, g, unknown or other
  misc_feature (513)..(530): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgccccccaaactcctcatttatcgtaacaacaatccggccctctggggtccctgaccgattctcccgcctccaagtctggcacctcagccctcgctggccatccacgtgggcctccgaggctggaggatggagggtnattacctacgtgacccaggtccgtacgaagtagttgggttacgggacgggtagggactaaggccttgacccgtcgtaggtccacgcccgaaggtcctccgcccccgttacggtctaccttccgtaccgttacccccaccccttacccgtcaacgtacttacggtacgttccgtaggacggtccggggcgtacggacgacggcgacgagtgannnnnnnnnnnnnnnnnn

SEQ ID NO: 263814 - DNA, 446 bp, Homo sapiens
  misc_feature: GYAE6OF01D4JGX.24.53.E09.1.454.CMB.1.raw
  modified_base (162)..(162): a, c, t, g, unknown or other
  misc_feature (162)..(162): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (429)..(446): a, c, t, g, unknown or other
  misc_feature (429)..(446): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcattttatcgtaacaacaatcggccctctggggtccctgaccgattctccgcctccaagtctggcacctcagcctcgctggccatcactggctccaggctgaggatgaggtgattacactgccagtcgtacgaagatggttcggcggagggactaagctgaccgtctaggtcagcccaaggctcgccccctggtcactctcgttcccnccctctcacatactacgngacgcgggctggacgaaggcncatagnnnnnnnnnnnnnnnnnn

SEQ ID NO: 263815 - DNA, 510 bp, Homo sapiens
  misc_feature: GYAE6OF01EBMJ5.24.53.E09.1.454.CMB.1.raw
  modified_base (112)..(112): a, c, t, g, unknown or other
  misc_feature (112)..(112): n is a, c, g, or t
  modified_base (166)..(166): a, c, t, g, unknown or other
  misc_feature (166)..(166): n is a, c, g, or t
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (420)..(420): a, c, t, g, unknown or other
  misc_feature (420)..(420): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(482): a, c, t, g, unknown or other
  misc_feature (478)..(482): n is a, c, g, or t
  modified_base (484)..(510): a, c, t, g, unknown or other
  misc_feature (484)..(510): n is a, c, g, or t
tcagactactatgtcacgaccggtgctcgattttagagagagtgtgttggggtttgggggctgtttttggaagctgcttgtaccagagggtcaccatctcctgcactgggancaacatcggcgcaggttttgatgtcccactggtacaagcagcttaccaaaaacncgccccccaaatcctcatttatccgtaacaacaatcggccctctggggtccctgaccgattcnccgcctccaagtctggccacctcacgccctcgctggccatccacgtgggcctccgaggcctggaggatggagggtnaacttactacgtcgccaggttcgtacggaagtattggttcggcggaggactaagctagacccgtcgtaggtccacgcccgaaggcctcggccccctggtccactctccgtccccncctcgtacactatacgtatcgtgacgcgggtctcggacgaaggccgctagtagnangnnnnnannnnnnnnnnnnnnnnnnnnnnnnnnn

SEQ ID NO: 263816 - DNA, 493 bp, Homo sapiens
  misc_feature: GYAE6OF01CFW53.24.53.E09.1.454.CMB.1.raw
  modified_base (163)..(163): a, c, t, g, unknown or other
  misc_feature (163)..(163): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (469)..(493): a, c, t, g, unknown or other
  misc_feature (469)..(493): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngcccccaaaactcctcatttatcgtaaacaacaatcggccctctggggtccctgaccgattcctccgcctccaagtctggcacctcagcctcgctggccatcactgggctccgaggctggaggatggagggtnattactactgccagtcgtcaagntgtcaggcggaggacaagctgaccgtctaggtcagcccaagggcctcgcccccgttcggtcctactccgtcgttcccccgccccttccgcaaccgtattaacgtcgttaccgtggacggcgggctcgggacaagggccgacgtatagcannnnnnnnnnnnnnnnnnnnnnnnn

SEQ ID NO: 263817 - DNA, 285 bp, Homo sapiens
  misc_feature: GYAE6OF01DZYTJ.24.53.E09.1.454.CMB.1.raw
  modified_base (283)..(285): a, c, t, g, unknown or other
  misc_feature (283)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtagtctgagcgggctggcaaggcgcatagnnn

SEQ ID NO: 263818 - DNA, 282 bp, Homo sapiens
  misc_feature: GYAE6OF01D1X70.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggaggagggactaagctgaccgtcctaggtcagcccaaggctgccccctcggtcactctgttcccgccctcctcacatagtagtctgagcgggctggcaaggcgcatagnnn

SEQ ID NO: 263819 - DNA, 486 bp, Homo sapiens
  misc_feature: GYAE6OF01A40YW.24.53.E09.1.454.CMB.1.raw
  modified_base (163)..(163): a, c, t, g, unknown or other
  misc_feature (163)..(163): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
  modified_base (449)..(449): a, c, t, g, unknown or other
  misc_feature (449)..(449): n is a, c, g, or t
  modified_base (451)..(453): a, c, t, g, unknown or other
  misc_feature (451)..(453): n is a, c, g, or t
  modified_base (455)..(486): a, c, t, g, unknown or other
  misc_feature (455)..(486): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaaacngccccccaaaactcctcattttatcgtaaacaacaatcggccctctggggtccctgaccgattcctccgcctccaagtctggccacctcagcctcgctggccatcactgggctccaggctgaggatgagggtnattacatcgcagtcgtcgaagntgtcggcggaggactaagctgacgtcnggtcagccgagctcgccctggcactctcgtccccgcctctcactatagtacgtcgtacggacgccggggtctacgggacgaaacgggccgacgaacttaacggngnnngnnnnnnnnnnnnnnnnnnnnnnnnnnnnnnnn

SEQ ID NO: 263820 - DNA, 545 bp, Homo sapiens
  misc_feature: GYAE6OF01EDZYD.24.53.E09.1.454.CMB.1.raw
  modified_base (283)..(284): a, c, t, g, unknown or other
  misc_feature (283)..(284): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (526)..(526): a, c, t, g, unknown or other
  misc_feature (526)..(526): n is a, c, g, or t
tcagactactatgtcacgaccggtgctcgattttagagagagtgtgttgggttgggggtgtggtggtacgtccactcccgccttgacggggctgctatctgcctcgctggccatcactgggctccaggctgaggatgagggtgattactacgtgccagtcgtcgaagatgttcggcggacggctaagctgaccgtcctaggtcagcccaaggcctgcccctggtcactctgttccccgcctcctcacatagtagtctgagcgggctggcaaggcgcaattagnnagncgcnganagtntacgcnacgtntagtgctacgtgtcggtctcagtcgnttcgcgcgctccgtgacgnagaactggacctcncgtcncgnactctcgactgaggtgaggtgagtacgttagtgtacgttcgtacttcggtacgtcggttactacggttacacgttaccgcgttacgcggttacgacggtctacggacgtacggtaccggcggtaacgtacgcgtcctaccgccgttaccncgtaactcgtacgcgttcg

SEQ ID NO: 263821 - DNA, 346 bp, Homo sapiens
  misc_feature: GYAE6OF01A0T8G.24.53.E09.1.454.CMB.1.raw
  modified_base (298)..(298): a, c, t, g, unknown or other
  misc_feature (298)..(298): n is a, c, g, or t
  modified_base (302)..(303): a, c, t, g, unknown or other
  misc_feature (302)..(303): n is a, c, g, or t
  modified_base (305)..(346): a, c, t, g, unknown or other
  misc_feature (305)..(346): n is a, c, g, or t
tcagactactatgtcacgaccggtgctcgatttagagagagtgtgttggggttgggggtgtggtggtctccactcccgccttgacggggctgctatcctgccctcgctcggcccactcacctcgggctcccaggctgaggatggagggtgagttactacgtcgccagtcgtcgaagatgttcggcggacgggacctaagctgaccgtccgtacgggtcagcccgaaggcctgccccctggtcactctcgttccccaccctcctcactatagtagtctgagcgggctggcaaggcacanacgnncnnnnnnnnnnnnnnnnnnnnnnnnnnnnnnnnnnnnnnnnnn

SEQ ID NO: 263822 - DNA, 607 bp, Homo sapiens
  misc_feature: GYAE6OF01CKFZH.24.53.E09.1.454.CMB.1.raw
  modified_base (582)..(584): a, c, t, g, unknown or other
  misc_feature (582)..(584): n is a, c, g, or t
  modified_base (586)..(607): a, c, t, g, unknown or other
  misc_feature (586)..(607): n is a, c, g, or t
tcagactactatgtcacgaccggtgctcgatttagagagagtgtgttgggtttgggggctgtttttggaagctgcttgtgccagagggtcaccatctcctgcactgggagcaacatcggcgcaggttttgatgtccactggtacaagcagcttaccaaaaacacgcccccaaactcctcatttatacgtaaacaacaatccggccctcgtcggggtccctgaccgattcctccgcctccaagtctggccacctcacgcctcgctcggcctatcacgtcggggcctccgagggctggaggatggaggggtgattacactcggcctaggtcgtacggaagtacgttggttccggggcgggtaagggacctaaaggccgtacggacccgttccgtacgggtccaacgggaccccgtaaagggccctacccggtcccccccgttcgggtacctaacccgttccgttacccggtttcccccggaccccctttcctcccgtaactaacgtttaacggttaacgttccgtagggaccgggtccggggtccgtacggggaaccgaacgggcccggtaactaaggtacggnnngnnnnnnnnnnnnnnnnnnnnnn

SEQ ID NO: 263823 - DNA, 282 bp, Homo sapiens; identical to SEQ ID NO: 263509
  misc_feature: GYAE6OF01BCLW9.24.53.E09.1.454.CMB.1.raw
  modified_base (280)..(282): a, c, t, g, unknown or other
  misc_feature (280)..(282): n is a, c, g, or t

SEQ ID NO: 263824 - DNA, 841 bp, Homo sapiens
  misc_feature: GYAE6OF01C4NH2.24.53.E09.1.454.CMB.1.raw
tcagactactatgtcacgaccggtgctcgatttagagagagtgtgttgggtttggggaggcttggtccagccgtggggggtccctgagactctcctgtgcagcctctggactttcccctttagtgtacttttggatgaccgtgggtccgccaggctccgaggggacggggctgggagtgggtggaccaaatataaggcacgatggacgtagcatgtactatgtggactctgtggaagggccgattcaccatctccagagacaacgcccaagaactcactgtatcgtaggaaatgaaccagcctaggaggagtacggaaggacgacggacttatgttaattacgtgtcgacgacctatactacgagacctaccgtgggacgtccgactataccgtagtaaacttaccttaccgaagtccgtaagggtttcgggggacccgtaacgggggccctaaccccggttcgggtaccccgtaacccggttcccttccccgtaccgaacccggtacccccttaaccccgaaaccccggaaacccggggtacccccctaacggtttccccgggttaccccccgttttcccccccggtccgggtcccccggtcccccggttacccggtcccgttaaccccgggaacgggacccggtacccccgtaaccccgttacccgggaacggtaaccggacccgaaccggtaaccgggccccggggtccccggtcgggggtaccccgttccgggaccccgggtttcgggtaaacccggttaaaacgggtaacccccttttaacccgttaccccgtaaacgttaaggtttaaccggttaacggttcccggttaacgggg

SEQ ID NO: 263825 - DNA, 457 bp, Homo sapiens
  misc_feature: GYAE6OF01AY6ES.24.53.E09.1.454.CMB.1.raw
  modified_base (162)..(162): a, c, t, g, unknown or other
  misc_feature (162)..(162): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (441)..(457): a, c, t, g, unknown or other
  misc_feature (441)..(457): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaactcctcatttatcgtaacaacaatcggccctctggggtccctgaccgattcctccgcctccaagtctggcacctcagcctcgctggccatcactgggctccaggctgaggatgagggtgattactactgccagtcgcgaagntgttcggcggagggactaagctgaccgtcctaggtcagcccaaggctcgcccctcggtcactctcgttccccaccctcctccactatagtagtctgagcgggctgggccaagggccgtnaagtagnnnnnnnnnnnnnnnnn

SEQ ID NO: 263826 - DNA, 622 bp, Homo sapiens
  misc_feature: GYAE6OF01DWRPR.24.53.E09.1.454.CMB.1.raw
  modified_base (164)..(164): a, c, t, g, unknown or other
  misc_feature (164)..(164): n is a, c, g, or t
  modified_base (314)..(314): a, c, t, g, unknown or other
  misc_feature (314)..(314): n is a, c, g, or t
  modified_base (586)..(587): a, c, t, g, unknown or other
  misc_feature (586)..(587): n is a, c, g, or t
  modified_base (590)..(590): a, c, t, g, unknown or other
  misc_feature (590)..(590): n is a, c, g, or t
  modified_base (593)..(622): a, c, t, g, unknown or other
  misc_feature (593)..(622): n is a, c, g, or t
tcagactactatgtcacgaccggtgctcgatttagagagagtgtgttgggtttgggggctgtttttggagctgcttgtaccagagggtcaccatctcctgcactggggagcaacatcggcgctaggttttgatgtccactggtacaagcagcttaccaaaaacncgaccccccaaactcctctattttatacgtaaacaacaatccggccctcgtcggggtccctgaccgtattcctcccgcctccaagtctcggccacctcagcctcgcgtcggccatccacgtgggcctccgaggctggaggatggagggtntacttactacgtcgaccgtagttccggtacgaaagtcgtttcgggttccgggacgggaagggtacctaaaggtccgttacgggtaaccccggttaccgttaggacccgaacggaccccgtaagggtcccgttcccggtccccccgtttcggtaccctaaccttcccgtttaccccgtttacccccctaccctccctacgaaccttagttacgttacgtcgacgggtacgggtcccgggtagtacgggaccgtagggacccgactaagtacgnncgnatnnnnnnnnnnnnnnnnnnnnnnnnnnnnnn

SEQ ID NO: 263827 - DNA, 444 bp, Homo sapiens
  misc_feature: GYAE6OF01BPLOS.24.53.E09.1.454.CMB.1.raw
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
  modified_base (431)..(444): a, c, t, g, unknown or other
  misc_feature (431)..(444): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgctccaagtctggcacctcagcctcgctggccatcactgggctccaggctgaggatgagggtgattactactgccagtcgtacgaagagtggttcggcggagggactaagctcgaccgtctaggtcagcccaagctcgcccctggtcactctcgttcccgccctcncactatagtntcgtgagcgggctggcaaggccncagtgcnnnnnnnnnnnnnn

SEQ ID NO: 263828 - DNA, 485 bp, Homo sapiens
  misc_feature: GYAE6OF01BVV1C.24.53.E09.1.454.CMB.1.raw
  modified_base (162)..(162): a, c, t, g, unknown or other
  misc_feature (162)..(162): n is a, c, g, or t
  modified_base (342)..(342): a, c, t, g, unknown or other
  misc_feature (342)..(342): n is a, c, g, or t
  modified_base (447)..(447): a, c, t, g, unknown or other
  misc_feature (447)..(447): n is a, c, g, or t
  modified_base (468)..(485): a, c, t, g, unknown or other
  misc_feature (468)..(485): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgcccccaaactcctcatttatcgtaaacaacaatcggccctcgtcggggtccctgaccgattccgtcccgcctaccaagtctggccacctcagcctcgctggccatcacgtgggctccgaggctgaggagtggagggtgtattactacgtgccaggtcgtacgaagtagtggtccgggngggagggactaagctcgaccgtcgtaggtcagccccaagggcctccgcccctggtcacctctccgtccccacctcctacacattacgtacgtcgtggacgcgggntcgggacgaaggccgacatgnnnnnnnnnnnnnnnnnn

SEQ ID NO: 263829 - DNA, 433 bp, Homo sapiens
  misc_feature: GYAE6OF01BRF3E.24.53.E09.1.454.CMB.1.raw
  modified_base (399)..(399): a, c, t, g, unknown or other
  misc_feature (399)..(399): n is a, c, g, or t
  modified_base (427)..(433): a, c, t, g, unknown or other
  misc_feature (427)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctggtcactctcgtcccgccctcctcacatagtntctgacgcgggctggcaaggcgcatagnnnnnnn

SEQ ID NO: 263830 - DNA, 383 bp, Homo sapiens
  misc_feature: GYAE6OF01BY9SC.24.53.E09.1.454.CMB.1.raw
  modified_base (361)..(361): a, c, t, g, unknown or other
  misc_feature (361)..(361): n is a, c, g, or t
  modified_base (377)..(383): a, c, t, g, unknown or other
  misc_feature (377)..(383): n is a, c, g, or t
tcagactactatgtcacgaccggtgctcgatttagagagagtgtgttgggtttgggggcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgagatgagggtgattactactgccagtcgtcgaagatgttcggcgagggactaagctgaccgtcctaggtcagcccaaggctcgccccctcggtcactctcgttcccgccctcctcacatagtacgtctgagcgggntggcaaggcgcatagnnnnnnn

SEQ ID NO: 263831 - DNA, 328 bp, Homo sapiens
  misc_feature: GYAE6OF01DLRAR.24.53.E09.1.454.CMB.1.raw
  modified_base (285)..(328): a, c, t, g, unknown or other
  misc_feature (285)..(328): n is a, c, g, or t
tcagactactatgtcacgaccggtgctcgatttagagagagtgtgttggggttgggggtgtggtggtctccactcccgccttgacggggctgctatctgcctcgctggccaatcactgggctccaggctgaggatgagggtgatttactactgccagttcgtcgaagatgttcggcggagggctaagctgacgtcctaggtcagcccaaggctcgccccctgggtccactctcgttccccgccctcctcacatagtagtctgagcggctggccaaggcgcatagnnnnnnnnnnnnnnnnnnnnnnnnnnnnnnnnnnnnnnnnnnnn

SEQ ID NO: 263832 - DNA, 453 bp, Homo sapiens
  misc_feature: GYAE6OF01B7WD4.24.53.E09.1.454.CMB.1.raw
  modified_base (163)..(163): a, c, t, g, unknown or other
  misc_feature (163)..(163): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (444)..(453): a, c, t, g, unknown or other
  misc_feature (444)..(453): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaacaacaatcggccctcgtggggtccctgaccgattcctccgcctccaagtctggcacctcagcctcgctggccatcacgtggctccagctgagntgaggtnattacactgccaggtcgtcgaagtatggtcggcggagggactaagctacgaccgtcctaggtcacgccaaggcctcgcccctggtcacgtcctcgttccccaccctcctcactagtacgtacgtctaggacgcggggctaggcaggccgcatgnnnnnnnnnn

SEQ ID NO: 263833 - DNA, 588 bp, Homo sapiens
  misc_feature: GYAE6OF01EBG0Y.24.53.E09.1.454.CMB.1.raw
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagcttgggttttccttgttgctattttagaaggtgtccagtgtgaggtgcaactggtggagtcgtgggggaggcttggttcaggccgtggggggtccctggagactctcctgtgcagcctctggtacttccccctttagtgtacttttggatgacctgggtccgccaggctccgaggggacggggctggaggtgggtgaccaatataaggcacggatggacgtagcatgtaactagtgtggtactcgtgtaggaagggccgtattccaaccatcctccgaagagaccaaccgcccaagaacctcactgtatctaggaaatcgaccagcctagagacgtacggagaccgacggactagtagttacttaagtgtacgtacccggaacctaagtacttaccgaacggtcccaacccgttggggaaacgttcccgctaaaccg

SEQ ID NO: 263834 - DNA, 436 bp, Homo sapiens
  misc_feature: GYAE6OF01BSH6P.24.53.E09.1.454.CMB.1.raw
  modified_base (430)..(436): a, c, t, g, unknown or other
  misc_feature (430)..(436): n is a, c, g, or t
tcagactactatgtcacgaccggtgctcgatttagagagagtgtgttgggtttgggggctgtttttggaagctgcttgtaccagaggttcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtcactctcgttcccgccctcctcacatacgtagtctgacgcggctggcaggcgcatagnnnnnnn

SEQ ID NO: 263835 - DNA, 282 bp, Homo sapiens
  misc_feature: GYAE6OF01D4ZDJ.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctcacatagtagtctgagcgggctggcaaggcgcatagnn

SEQ ID NO: 263836 - DNA, 286 bp, Homo sapiens
  misc_feature: GYAE6OF01D1P8P.24.53.E09.1.454.CMB.1.raw
  modified_base (284)..(286): a, c, t, g, unknown or other
  misc_feature (284)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtagtctgagcgggctgggcaaggcgcatagnnn

SEQ ID NO: 263837 - DNA, 450 bp, Homo sapiens
  misc_feature: GYAE6OF01DK7E2.24.53.E09.1.454.CMB.1.raw
  modified_base (288)..(288): a, c, t, g, unknown or other
  misc_feature (288)..(288): n is a, c, g, or t
  modified_base (442)..(450): a, c, t, g, unknown or other
  misc_feature (442)..(450): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagcttccaaaaacagcccccaaatcctcatttatcgtaacaacaatcggccctctggggtccctgaccgattcctccgcctccaagtctggcacctcagcctcgctggccatcactgggctccaggctgaggatgagggtnattactactgccagtcgtcgaagatggttcggcggagggactaagctgaccgtctaggtcagcccaaggctcgccccctggtccacttctcgttccccacccgttcctcaacattagtacgtctaggacggcgggctggacaagggcacatagnnnnnnnnn

SEQ ID NO: 263838 - DNA, 281 bp, Homo sapiens
  misc_feature: GYAE6OF01A1JQJ.24.53.E09.1.454.CMB.1.raw
  modified_base (274)..(274): a, c, t, g, unknown or other
  misc_feature (274)..(274): n is a, c, g, or t
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcncatagnn

SEQ ID NO: 263839 - DNA, 444 bp, Homo sapiens
  misc_feature: GYAE6OF01EEFGW.24.53.E09.1.454.CMB.1.raw
  modified_base (424)..(424): a, c, t, g, unknown or other
  misc_feature (424)..(424): n is a, c, g, or t
  modified_base (430)..(444): a, c, t, g, unknown or other
  misc_feature (430)..(444): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactggctccaggctgaggatgagggtgattacactgccagtcgtcgaagatggttcggcggagggactaagctgaccgtctaggtcagcccaaggctcgcccctggtcactctcgtccccaccctcctcacatagtacgtctgacgcgggctggacaaggcncatagnnnnnnnnnnnnnnn

SEQ ID NO: 263840 - DNA, 284 bp, Homo sapiens
  misc_feature: GYAE6OF01BCQ25.24.53.E09.1.454.CMB.1.raw
  modified_base (279)..(284): a, c, t, g, unknown or other
  misc_feature (279)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctgttccccaccctcctcacatagtagtctgagcgggctggcaaggcgcatagnnnnnn

SEQ ID NO: 263841 - DNA, 467 bp, Homo sapiens
  misc_feature: GYAE6OF01CHCXQ.24.53.E09.1.454.CMB.1.raw
  modified_base (291)..(291): a, c, t, g, unknown or other
  misc_feature (291)..(291): n is a, c, g, or t
  modified_base (385)..(385): a, c, t, g, unknown or other
  misc_feature (385)..(385): n is a, c, g, or t
  modified_base (434)..(439): a, c, t, g, unknown or other
  misc_feature (434)..(439): n is a, c, g, or t
  modified_base (442)..(467): a, c, t, g, unknown or other
  misc_feature (442)..(467): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccctaaactcctcatttatcgtaacaacaatcggccctctggggtccctgaccgattctccgccgtccaagtctggcacctcagcctcgctggccatcactgggctccaggctgaggatgagggtnattacactgccagtcgtcgaagatgttcggcggagggactaagctgaccgtcctaggtcagcccaaggctcgccccctggtcactctcgtcccnccgtcctcacatagtgtctgagcggtctggcaaggcgctagttagctannnnnncgnnnnnnnnnnnnnnnnnnnnnnnnnn

SEQ ID NO: 263842 - DNA, 471 bp, Homo sapiens
  misc_feature: GYAE6OF01DKIVM.24.53.E09.1.454.CMB.1.raw
  modified_base (161)..(161): a, c, t, g, unknown or other
  misc_feature (161)..(161): n is a, c, g, or t
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
  modified_base (436)..(471): a, c, t, g, unknown or other
  misc_feature (436)..(471): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattcnccgctcaagtctggccacctcagcctcgctggccatcactgggctccaggctgagatgaggtnattacactgccagtgtcgaagntgttcggngagggactaagctgaccgtctaggtcngacccaggcctcgccccctaggtcactcctcgttccccgcccttcgtcaanatagtacgtctgagcgggtcgtcggactaaggccacgatacggnnnnnnnnnnnnnnnnnnnnnnnnnnnnnnnnnnnn

SEQ ID NO: 263843 - DNA, 440 bp, Homo sapiens
  misc_feature: GYAE6OF01EYNDM.24.53.E09.1.454.CMB.1.raw
  modified_base (186)..(186): a, c, t, g, unknown or other
  misc_feature (186)..(186): n is a, c, g, or t
  modified_base (387)..(387): a, c, t, g, unknown or other
  misc_feature (387)..(387): n is a, c, g, or t
  modified_base (433)..(440): a, c, t, g, unknown or other
  misc_feature (433)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcattttancgtaaacaacaatcggccctctggggtccctgaccgattctccgcctccaagtctggcacctcagcctcgctggccatcactgggctccaggctgaggatggagggtgattactactgccagtcgtcgaagatggttcggcggagggactaagctgaccgtctaggtcagccaaggctcgcccctggtcactctcgtcccnccctcctcacatagtagtctgacgcgggctggcaaggcgacatagnnnnnnnn

SEQ ID NO: 263844 - DNA, 620 bp, Homo sapiens
  misc_feature: GYAE6OF01EGFND.24.53.E09.1.454.CMB.1.raw
  modified_base (321)..(321): a, c, t, g, unknown or other
  misc_feature (321)..(321): n is a, c, g, or t
  modified_base (595)..(595): a, c, t, g, unknown or other
  misc_feature (595)..(595): n is a, c, g, or t
  modified_base (597)..(620): a, c, t, g, unknown or other
  misc_feature (597)..(620): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacacgaccccccaaaactccctctaattttatacgtaaacaaacaactccggccctcgtcggggtcccctgaccgtattcctcccgccctccaagtctggccaccctcacgccctcgctcggccatccacgtgggcctccgaggctgaggatggagggtnattactacgtgccaggtcgtacggaagtagttggttaccgggacgggaagggtaactaaaggcgtacggtaaccccggttaccgtaacggtccgaaccggacccccgtaaagggcccttcccggacccccccgttcgggtaccctaaccctttcccgttacccgtttaccccccctaccccctttccctaccaaccgttacgtttaacggttacgttaccgtagggacgggccggggtacgtacgggaccgaaacgggccgaccgtagtacggngnnnnnnnnnnnnnnnnnnnnnnnn

SEQ ID NO: 263845 - DNA, 329 bp, Homo sapiens
  misc_feature: GYAE6OF01DF5UP.24.53.E09.1.454.CMB.1.raw
  modified_base (287)..(329): a, c, t, g, unknown or other
  misc_feature (287)..(329): n is a, c, g, or t
tcagactactatgtcacgaccggtgctcgatttagagagagtgtggttggggtttggggggtgtggtggtctccacctcccgccttgacgggctgctatctgcctcgcctggccatcacttggctccaggctgaggatggagggtgactttactactgccagtcgtcgaagatgttcggcggagggactaagctgaccgtctaggtcagccaaggctgcccctggcactctcgttcccaccgtcctcactagtagtagtctggagcgggctggcaaggcgctacagnnnnnnnnnnnnnnnnnnnnnnnnnnnnnnnnnnnnnnnnnnn

SEQ ID NO: 263846 - DNA, 644 bp, Homo sapiens
  misc_feature: GYAE6OF01DLKB5.24.53.E09.1.454.CMB.1.raw
tcagactactatgtcacgaccggtgctcgatttagagagagtgtgttgggtttggggaggcttggtccagccgtgggggtccctgagactctcctgtgcagcctctggacttccccttttagtgtactttttggatgacctgggtccgccaggcctccgagggacggggctggagtgggtggaccaatataaggcacgatggacgtagcatgtactatgtgactctgtgaaggccattcaccatctcagagacaacgcccagaacctcactgtaactcgaggaaaatgaccagcctagagagtcgaggacacggctagtgtattactgtgcgaccatatcagccacgtgagtcgcatctagaaatccttccagcctaagttcggggccagggaccacccgtggtacccaccggttcctcctccacgtccctacccaaccgtaaaccggggcccctaagttccccgggttccctttcccccccgtagggcccctccccgttcgccctacccgacgggaccgcccgtacccgtcccggaagacgacccgaacgaccggccggccccgtggggccgtcggcccgtgggttaccgaaacgggttaccttacccttacccaacgtaatttacggtaacgttcgtacggg

SEQ ID NO: 263847 - DNA, 448 bp, Homo sapiens
  misc_feature: GYAE6OF01CDUFK.24.53.E09.1.454.CMB.1.raw
  modified_base (163)..(163): a, c, t, g, unknown or other
  misc_feature (163)..(163): n is a, c, g, or t
  modified_base (441)..(448): a, c, t, g, unknown or other
  misc_feature (441)..(448): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaacaacaatcggccctctggggtccctgaccgattctcccgcctccaagtctggccacctcagcctcgctggccatcactgggctccaggctgaggatgagggtgattactactgccagtcgtcgaagatgttcggcggagggactaagctgaccgtcctaggtcacgcccaaggctcgccccctggtcactctcgttccccgccctcctcactatacgtagtctggacgcgggctgggcaacggcgcagtgnnnnnnnn

SEQ ID NO: 263848 - DNA, 322 bp, Homo sapiens
  misc_feature: GYAE6OF01DDY71.24.53.E09.1.454.CMB.1.raw
  modified_base (299)..(322): a, c, t, g, unknown or other
  misc_feature (299)..(322): n is a, c, g, or t
tcagactactatgtcacgaccggtgctcgatttagagagagtgtggttgggtttggggggtgtggtggtctccactcccgccttgacggggctgctatctgcctcgctggccatcactgggctccaggctgaggatggagggtgattactactaccagtcgtcgaagatgttcggcggagggactaagctgaccgtctaggtcacgcccaaggctcgcccccgtcggtcactctcgttccccacctcctcactattagtagtccgtggacggcgggctgggacaacggccgacagtagnnnnnnnnnnnnnnnnnnnnnnnn

SEQ ID NO: 263849 - DNA, 449 bp, Homo sapiens
  misc_feature: GYAE6OF01CNPK0.24.53.E09.1.454.CMB.1.raw
  modified_base (161)..(161): a, c, t, g, unknown or other
  misc_feature (161)..(161): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (429)..(449): a, c, t, g, unknown or other
  misc_feature (429)..(449): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacncgcccccaaactcctcatttatcgtaaacaacaatcggccctctggggtccctgaccgattctccgcctcaagtctggcacctcagcctcgctggccatcactgggctccaggctgaggatgagggtgattacactgccagtcgtcgaagatgttcgggcggagggactaagctgaccgtcagtcagcccaaggcncgccccctggcactctcgtccccacctccncacatagtagtctgagcgggctggcaacgggcgacagtacgnnnnnnnnnnnnnnnnnnnnn

SEQ ID NO: 263850 - DNA, 291 bp, Homo sapiens
  misc_feature: GYAE6OF01D9NWW.24.53.E09.1.454.CMB.1.raw
  modified_base (285)..(291): a, c, t, g, unknown or other
  misc_feature (285)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccgccctcctcacatagtagtctgaggcgggctggcaagggcgcatagnnnnnnn

SEQ ID NO: 263851 - DNA, 435 bp, Homo sapiens
  misc_feature: GYAE6OF01E12FF.24.53.E09.1.454.CMB.1.raw
  modified_base (162)..(162): a, c, t, g, unknown or other
  misc_feature (162)..(162): n is a, c, g, or t
  modified_base (420)..(420): a, c, t, g, unknown or other
  misc_feature (420)..(420): n is a, c, g, or t
  modified_base (426)..(435): a, c, t, g, unknown or other
  misc_feature (426)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaaacaacaatcggccctctggggtccctgacccgattctcccgcctccaagtctggcacctcagcctcgctggccatcactggctccaggctgaggatgagggtgattactactgccagtctcgaagatgtcggcggagggactaagctgaccgtctaggtcagcccaaggcctcgccccctggtcactctcgtccccacctctcacatagagtctgagcgggctggcaggcncatagnnnnnnnnnn

SEQ ID NO: 263852 - DNA, 478 bp, Homo sapiens
  misc_feature: GYAE6OF01DEJ8A.24.53.E09.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (456)..(478): a, c, t, g, unknown or other
  misc_feature (456)..(478): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaaacncgccccccaaatcctcattttanacgtaacaacaatccggccctcgtggggtccctgaccgtattcctcccgcctccaagtcctggccacctcacgcctcgctggccatcacgtggctcaggctgaggatgagggtnattactactgcctagtcgtacgaagntggttcggcggaggactaagctcgaccgtctaggcacgccgaaggctccgcccccttggtccacttctcgttaccccnccctcctacactatacgtatctggagcgggntggcgaacggcgacagtacgnnnnnnnnnnnnnnnnnnnnnnn

SEQ ID NO: 263853 - DNA, 443 bp, Homo sapiens
  misc_feature: GYAE6OF01CPQRR.24.53.E09.1.454.CMB.1.raw
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
  modified_base (432)..(443): a, c, t, g, unknown or other
  misc_feature (432)..(443): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccattggtacaagcagcttccaaaaacncgcccccaaactcctcatttatcgtaaacaacaatcggccctntggggtccctgaccgattctccgcctccaagtctggcacctcagcctcgctggccatcactggctccaggctgaggatggagggtgatttactactgccagtcgtcgaagatgtcggcggaggactaagctgaccgtcctaggtcagcccaaggcctcgcccctggtcactctcgttccccgccctctcacatagtagtctgacgcgggctggcaagggcacatagcnnnnnnnnnnnn

SEQ ID NO: 263854 - DNA, 575 bp, Homo sapiens
  misc_feature: GYAE6OF01B13VJ.24.53.E09.1.454.CMB.1.raw
  modified_base (450)..(450): a, c, t, g, unknown or other
  misc_feature (450)..(450): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccaggggacggggctggagtgggtggccaatataaggcacgatggacgtagcatgtactatgtggactctgtgaagggccattcaccatctccagagacaacgcccagaactcactgtatctaggaaatgaccagcctgagagtcgaggacacggctatgtattactgtgcgaccatatcagcaccgtggagtcgcatctagaacttcctccagtcagttggggccagggccacccgtggtaccaccgtctcctcacgccctccaccgacggcccacgtccggtccttccccgcggccnccctcgcctccgacggaccgacctaccgtccgaagacgaccacgacggcccggcccgtcgggccgtcggtcccgtacggtaccgaacggtacccttaccgactaagttagtacgtcgtggacggg

SEQ ID NO: 263855 - DNA, 283 bp, Homo sapiens
  misc_feature: GYAE6OF01BK8Y8.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnnn

SEQ ID NO: 263856 - DNA, 430 bp, Homo sapiens
  misc_feature: GYAE6OF01E262Y.24.53.E09.1.454.CMB.1.raw
  modified_base (428)..(430): a, c, t, g, unknown or other
  misc_feature (428)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagccccaaggctgccccctcggtcactctgttcccgccctcctcacatagtagtctgagcgggctggcaaggcgcatagnnn

SEQ ID NO: 263857 - DNA, 287 bp, Homo sapiens
  misc_feature: GYAE6OF01A41JA.24.53.E09.1.454.CMB.1.raw
  modified_base (285)..(287): a, c, t, g, unknown or other
  misc_feature (285)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggcctcgccccctcggtcactctcgttccccaccctcctcacatagtagtctgagcgggctggcaaggcgcatagnnn

SEQ ID NO: 263858 - DNA, 598 bp, Homo sapiens
  misc_feature: GYAE6OF01A0OOA.24.53.E09.1.454.CMB.1.raw
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccaggggacggggctggagtgggtggccaatataaggcacgatggacgtagcatgtactatgtggactctgtgaaggccgattcacatctcaganacaacgcccagaactcactgtatctaggaaatgaccagcctgagagtcgaggacacggctatgtattacngtgcgacatactcagcaccgtggacgtcgcatctagaactaccttccagctagttcggggccaggggccctaccgtcggtccaccgtctccctcaccgtcctcccaacccgaacgggcccctacgttcccggttccctttcccccggtcggtccccgccctcgccctcccgacggacgcccgacccgtccggacgacgaccaccgacggccggcccgtcgggccgtcggccgtcgggcaacgggtaccttaccgttaccacgtatacggtagtcgtacggg

SEQ ID NO: 263859 - DNA, 554 bp, Homo sapiens
  misc_feature: GYAE6OF01DUP9N.24.53.E09.1.454.CMB.1.raw
  modified_base (535)..(554): a, c, t, g, unknown or other
  misc_feature (535)..(554): n is a, c, g, or t
tcagactactatgtcacgaccggtgctcgatttagagagagtgtgttgggtttgggggctgttttggaagctgcttgtaccagagggtcaccatctcctgcactgggagcaacatcggcgctaggttttgatgtccactggtacaagcagcttaccaaaaacacgacccccaaactcctacatttatacgtaaacaacaactcggccctcgtcggggtccctgaccgattcctccgcctccaagtctggccacctcacgcctcgctcggccatcacgttggcctccgaggctagatgagtggagggtactattaactacgtcgacctaggtacgtacgaaagtgttcgggttcgggaccgggaagggtactaaggcgtacggtacccggtcgtaggtaccacgacccgaaggtccgtcccgccccccgtcggtacctcctaccgttccgttaccccccacccgtcccttacaaccgttagtaacgttacgtcgtgggacggtcgggacgtaggaccgaacggtcgacgtaagcgnnnnnnnnnnnnnnnnnnnn

SEQ ID NO: 263860 - DNA, 436 bp, Homo sapiens
  misc_feature: GYAE6OF01EP764.24.53.E09.1.454.CMB.1.raw
  modified_base (430)..(436): a, c, t, g, unknown or other
  misc_feature (430)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaaactcctcattttatcgtaacaacaatcggccctctggggtccctgaccgattcctccgcctccaagtctggcacctcagcctcgctggccatcactgggctccaggctggagatgaggtgattacactgccagtcgtcgaagatggtcggcggaggactaagctgaccgtcctaggtcagcccaagcctcgccccctggtccactctcgttcccaccctcctcacatagtagtctgacgcgggctggacaaggcgcatgnnnnnnn

SEQ ID NO: 263861 - DNA, 464 bp, Homo sapiens
  misc_feature: GYAE6OF01BSWTD.24.53.E09.1.454.CMB.1.raw
  modified_base (163)..(163): a, c, t, g, unknown or other
  misc_feature (163)..(163): n is a, c, g, or t
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (448)..(464): a, c, t, g, unknown or other
  misc_feature (448)..(464): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgacccccaaactcctcattttatacgtaaacaacaatccggcccttgtcggggtccctgaccgtattcctccgcctccaagtctggccacctcacgccctcgctggccatcacgtggctccaggctgaggatgagggtnagtttactacgtgccgagtcggtacgaagatggttcggnggagggactaagctgaccgtctagtcacgccaaggctcgccccctggtcactctcgtccctacctcctcacatagtacgtntgagcggntggcaaggcgacatagnnnnnnnnnnnnnnnnn

SEQ ID NO: 263862 - DNA, 299 bp, Homo sapiens
  misc_feature: GYAE6OF01EDCET.24.53.E09.1.454.CMB.1.raw
  modified_base (292)..(299): a, c, t, g, unknown or other
  misc_feature (292)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggcctgccccctggtcactctcgttccccgccctcctacacataggtagtcctggacgcgggctgggccaaaggtcgcaatagnnnnnnnn

SEQ ID NO: 263863 - DNA, 443 bp, Homo sapiens
  misc_feature: GYAE6OF01E1GBY.24.53.E09.1.454.CMB.1.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (430)..(443): a, c, t, g, unknown or other
  misc_feature (430)..(443): n is a, c, g, or t
tcagactactatgtcacgaccggtgctcgatttagagagagtgtgttgggtttgggggctgtttttggaatctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgctccaagtctggcacctcagcctcgctggccatcactggctccaggctgaggatgagggtgattactactgccagtcgtcgaagatgttcggcggagggactaagctgaccgtctaggtcagcccaaggctcgcccctggtcactctcgtccccgccctcctcacatagtacgtctgagcgggntcgggcaaggccncagtagnnnnnnnnnnnnnn

SEQ ID NO: 263864 - DNA, 285 bp, Homo sapiens
  misc_feature: GYAE6OF01C02H8.24.53.E09.1.454.CMB.1.raw
  modified_base (282)..(285): a, c, t, g, unknown or other
  misc_feature (282)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagcccaaggcctcgcccctcggtcactctcgttcccaccctcctcacatagtagtctgagcgggctggcaaggcgcatagnnnn

SEQ ID NO: 263865 - DNA, 457 bp, Homo sapiens
  misc_feature: GYAE6OF01ETY83.24.53.E09.1.454.CMB.1.raw
  modified_base (442)..(457): a, c, t, g, unknown or other
  misc_feature (442)..(457): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtctaggtcacgcccaaggctcgccccctggtcactctcgttccccgccctcctcacattacgtcgtctgaggccggggctcgggcaagggccgcataggcnnnnnnnnnnnnnnnn

SEQ ID NO: 263866 - DNA, 455 bp, Homo sapiens
  misc_feature: GYAE6OF01A9N4N.24.53.E09.1.454.CMB.1.raw
  modified_base (162)..(162): a, c, t, g, unknown or other
  misc_feature (162)..(162): n is a, c, g, or t
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
  modified_base (425)..(425): a, c, t, g, unknown or other
  misc_feature (425)..(425): n is a, c, g, or t
  modified_base (431)..(455): a, c, t, g, unknown or other
  misc_feature (431)..(455): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaactcctcatttatcgtaacaacaatcggccctctggggtccctgaccgattctccgcctccaagtctggcacctnagcctcgctggccatcactgggctccaggctgaggatgagggtgattaccactgccagtcgtcgaagntgttcggcggaggactaagctgaccgtctaggtcagcccaaggctcgccccctggtcactctcgtccccaccctcctcacatagtacgtctgacgcgggctggcaaggcncatagnnnnnnnnnnnnnnnnnnnnnnnnn

SEQ ID NO: 263867 - DNA, 890 bp, Homo sapiens
  misc_feature: GYAE6OF01E2K99.24.53.E09.1.454.CMB.1.raw
tcagactactatgtcacgaccggtgctcgatttagagagagtgtgttgggtttggggaggcttggtccagccctggggggtccctgagactctcctgtgcagcccctgtgtaccctttacccgtttagtcgtttacgttttggatccgtaccggttccggggtccccgaccgacggtccctaccgggaacggggggaccggggtcgtagggtaggggttgggggtccggaacctaaaattaaagtaaacggccgaacgtaggtacgggtaacggtacgactagttacgttaacttagttgggtacggtaccttcgtggtaagggaaccgggccttacttacccaactacttccctaccgaaggaaccgaaaccgaaccccgacccgaaacgtaacctcctaacgttagttaacttacggtaaggtaaagtaccgaaccgacgtccgtaggaaggtacggtacggaacggaaccgaccggtacttagttagttaactttacgtggtcggacccgaacctaattactacgacgaccctaccggtaggtacgtccgactacttcgtaagtaaactttaccctacgacgtacttaggggtccgggaccggacgggtacccctacccgggttcgacccgtacccgttcctccctacgacccgtacccctacccgaaccggaacccggccctacggttcccgttcccccttccccggcggcccccgtccctacgtccctaaccggacggaccctacccgtaccccgtacggaacggaccacccaacggaccggcccccggtcccgggtacggtcccgtccggtcccggtacgggtaacccgaaaccggttacccttaacccgtacccaagttaagtaacggttccgtcggtacggg

SEQ ID NO: 263868 - DNA, 285 bp, Homo sapiens
  misc_feature: GYAE6OF01BUE16.24.53.E09.1.454.CMB.1.raw
  modified_base (282)..(285): a, c, t, g, unknown or other
  misc_feature (282)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtccactctcgttcccgccctcctcacatagtagtctgagcgggctggcaaggcgcatagnnnn

SEQ ID NO: 263869 - DNA, 279 bp, Homo sapiens
  misc_feature: GYAE6OF01CJDLG.24.53.E09.1.454.CMB.1.raw
  modified_base (272)..(272): a, c, t, g, unknown or other
  misc_feature (272)..(272): n is a, c, g, or t
  modified_base (278)..(279): a, c, t, g, unknown or other
  misc_feature (278)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagccaaggctgccccctggtcactctgttcccaccctcctcacatagtagtctgagcgggctggcaaggcncatagnn

SEQ ID NO: 263870 - DNA, 283 bp, Homo sapiens
  misc_feature: GYAE6OF01DA360.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnn

SEQ ID NO: 263871 - DNA, 477 bp, Homo sapiens
  misc_feature: GYAE6OF01DITNE.24.53.E09.1.454.CMB.1.raw
  modified_base (113)..(113): a, c, t, g, unknown or other
  misc_feature (113)..(113): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (425)..(429): a, c, t, g, unknown or other
  misc_feature (425)..(429): n is a, c, g, or t
  modified_base (431)..(477): a, c, t, g, unknown or other
  misc_feature (431)..(477): n is a, c, g, or t
tcagactactatgtcacgaccggtgctcgatttagagagagtgtgttggggtttggggagcaacatcggcgcaggttttgatgtccactggtacaagcagcttccaaaaaacncgccccccaaaactccctcatttatcgtaacaacaatccggcccctcgtggggtcccctgaccgtattcctccgcctccaagtctggcacctcacgcctcgctggccatcactgggctccaggctgacggatggagggtgattacactgcaggtcgtcgaaagatggttcggcggagggaactaagcgtcgacgtcctaggtcagacccaagcctacgcccccgtggtcacctcgtccgtacccaccctcctanacctagtagtacgtctaggcggacgggtctggaccgaaagggccacgaataggcngannnnngnnnnnnnnnnnnnnnnnnnnnnnnnnnnnnnnnnnnnnnnnnnnnnn

SEQ ID NO: 263872 - DNA, 470 bp, Homo sapiens
  misc_feature: GYAE6OF01EI23S.24.53.E09.1.454.CMB.1.raw
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (455)..(470): a, c, t, g, unknown or other
  misc_feature (455)..(470): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgccccccaaactcctcattttatcgtaacaacaatccggccctcgtcggggtccctgaccgattcctccgcctccaagtctggcacctcacgccctcgctggccatcacgtgggctccgaggctggaggatggagggtnattactactgccagtcgtacgaagntggttcgggnggagggactaagctgacccgtcgtaggtcacgccaaggctccgccccgtccgtctactctccgtccccncccctcctcactatagtacgtcngagcgggtctggngaggcgcanagnnnnnnnnnnnnnnnn

SEQ ID NO: 263873 - DNA, 282 bp, Homo sapiens
  misc_feature: GYAE6OF01CMD7R.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagccaaggctcgcccctcggtcactctcgttcccacctcctcactatagtagtctgagcgggctggcaaggcgcaatgnnnn

SEQ ID NO: 263874 - DNA, 282 bp, Homo sapiens
  misc_feature: GYAE6OF01AG664.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctgggcaaggcgcatagnnn

SEQ ID NO: 263875 - DNA, 434 bp, Homo sapiens
  misc_feature: GYAE6OF01AWQY3.24.53.E09.1.454.CMB.1.raw
  modified_base (427)..(434): a, c, t, g, unknown or other
  misc_feature (427)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctcggtcactctcgtccccgccctcctcacatagtagtctgagcgggctggcaaggcgcatagnnnnnnnn

SEQ ID NO: 263876 - DNA, 284 bp, Homo sapiens
  misc_feature: GYAE6OF01B8Q7D.24.53.E09.1.454.CMB.1.raw
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggcctgccccctggtcactctcgttccccaccctcctcacatagtagtctgagcgggctggcaaggcgcatagnnn

SEQ ID NO: 263877 - DNA, 284 bp, Homo sapiens
  misc_feature: GYAE6OF01A4P8Z.24.53.E09.1.454.CMB.1.raw
  modified_base (283)..(284): a, c, t, g, unknown or other
  misc_feature (283)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatagnn

SEQ ID NO: 263878 - DNA, 488 bp, Homo sapiens
  misc_feature: GYAE6OF01A77IP.24.53.E09.1.454.CMB.1.raw
  modified_base (161)..(161): a, c, t, g, unknown or other
  misc_feature (161)..(161): n is a, c, g, or t
  modified_base (286)..(287): a, c, t, g, unknown or other
  misc_feature (286)..(287): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (467)..(488): a, c, t, g, unknown or other
  misc_feature (467)..(488): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggtttgatgtccactggtacagcagcttaccaaaaacncgcccccaaactcctcatttatcgtaacaacaatcggccctcgtggggtccctgaccgtattctccgcctccaagtctggcacctcagccctcgctggccatcactgggctccgaggctggaggnnggaggtnattacactgccaggtcgtagaagntggtcggnggaggatagctcgaccgtcgtacggtcaggccccaaggcctccgcccccgtggtccactcttccgttccccaccgttccctcatacgtagtacgtcgtggacggccggggtctcgggacgtaacgggccgaccgatacggnnnnnnnnnnnnnnnnnnnnnn

SEQ ID NO: 263879 - DNA, 542 bp, Homo sapiens
  misc_feature: GYAE6OF01E1OZT.24.53.E09.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (299)..(299): a, c, t, g, unknown or other
  misc_feature (299)..(299): n is a, c, g, or t
  modified_base (506)..(506): a, c, t, g, unknown or other
  misc_feature (506)..(506): n is a, c, g, or t
  modified_base (512)..(542): a, c, t, g, unknown or other
  misc_feature (512)..(542): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaaactcctcatttancgtaaacaacaatcggccctctggggtccctgaccgattcctccgcctccaagtctggccacctcagccctcgctcggccatcactgggcctccaggctggagatggagggtntattactacgtcgccagtcgtacgaagtatggttcggcgggagggactaagctagacccgtctaggtccagccccgaaggctccggccccctggtcctactccgttccgttacccccgtcccctccgtacctactagttacggtacgttcgtacggacgggtccggggtcgttcgggacgtaacggggccgtaccgtaagttacggnacgtcnnnnnnnnnnnnnnnnnnnnnnnnnnnnnnn

SEQ ID NO: 263880 - DNA, 525 bp, Homo sapiens
  misc_feature: GYAE6OF01D37KP.24.53.E09.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (500)..(500): a, c, t, g, unknown or other
  misc_feature (500)..(500): n is a, c, g, or t
  modified_base (504)..(525): a, c, t, g, unknown or other
  misc_feature (504)..(525): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgccccccaaatcctcatttanacgtaaacaacaatccggccctcgtcggggtccctgaccgattccncccgcctaccaagtctggccacctcacgcctcgctggccatcacgtgggcctccgaggctggaggatggagggtntacttacactgcccaagtcgtacgaaagtnttggtcgggcggaagggactaagcgtacgaccgtacgtaggcaacggcccgtaaggccctccgccccccttgggtaccactcctttacgtcccccgtccctaccctactaaccagttacgttacgtactgggacgtccggggatccggaggaacggccgactaancggnnnnnnnnnnnnnnnnnnnnnn

SEQ ID NO: 263881 - DNA, 297 bp, Homo sapiens
  misc_feature: GYAE6OF01CKGT0.24.53.E09.1.454.CMB.1.raw
  modified_base (283)..(297): a, c, t, g, unknown or other
  misc_feature (283)..(297): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagcccaaggctgccccctcggtcactctcgttcccacctcctcacatagtacgtctggagcgggctggacaaggcgcatagnnnnnnnnnnnnnnn

SEQ ID NO: 263882 - DNA, 440 bp, Homo sapiens
  misc_feature: GYAE6OF01EP7IG.24.53.E09.1.454.CMB.1.raw
  modified_base (424)..(424): a, c, t, g, unknown or other
  misc_feature (424)..(424): n is a, c, g, or t
  modified_base (430)..(440): a, c, t, g, unknown or other
  misc_feature (430)..(440): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggcactctcgtccccaccctcctcacatagtagtctgacgcgggtctggcaaggcncatagnnnnnnnnnnn

SEQ ID NO: 263883 - DNA, 441 bp, Homo sapiens
  misc_feature: GYAE6OF01A0CAJ.24.53.E09.1.454.CMB.1.raw
  modified_base (162)..(162): a, c, t, g, unknown or other
  misc_feature (162)..(162): n is a, c, g, or t
  modified_base (313)..(313): a, c, t, g, unknown or other
  misc_feature (313)..(313): n is a, c, g, or t
  modified_base (387)..(387): a, c, t, g, unknown or other
  misc_feature (387)..(387): n is a, c, g, or t
  modified_base (428)..(441): a, c, t, g, unknown or other
  misc_feature (428)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagntggtcggcggagggactaagctgaccgtcaggtcagccaggctcgcccctggtcactctcgttccccacctccncacatagtagtctgacgcgggtctggacaacggcgcagtgnnnnnnnnnnnnnn

SEQ ID NO: 263884 - DNA, 516 bp, Homo sapiens
  misc_feature: GYAE6OF01ATMW2.24.53.E09.1.454.CMB.1.raw
  modified_base (163)..(163): a, c, t, g, unknown or other
  misc_feature (163)..(163): n is a, c, g, or t
  modified_base (298)..(298): a, c, t, g, unknown or other
  misc_feature (298)..(298): n is a, c, g, or t
  modified_base (479)..(479): a, c, t, g, unknown or other
  misc_feature (479)..(479): n is a, c, g, or t
  modified_base (481)..(482): a, c, t, g, unknown or other
  misc_feature (481)..(482): n is a, c, g, or t
  modified_base (486)..(516): a, c, t, g, unknown or other
  misc_feature (486)..(516): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaactcctcatttatcgtaaacaacaatcggcccttcgtggggtccctgaccgattcctccgcctccaagtctggcacctcagcctcgctggccatcacgtgggcctccgaggctgagagtggagggtnattactactgccagtcgtacgaagtagtcggttcggcgggtagggactaaggctcggaccgtcgtaggtccagcccaaggctccgtccccgtggtccactcctccgtccccgccctaccgtacacgtattacggtagtccgtggacggccgggtcgtcggtacgaacgggcgacagtacgncnncgtnnnnnnnnnnnnnnnnnnnnnnnnnnnnnnn

SEQ ID NO: 263885 - DNA, 284 bp, Homo sapiens; identical to SEQ ID NO: 263665
  misc_feature: GYAE6OF01D8JPF.24.53.E09.1.454.CMB.1.raw
  modified_base (281)..(284): a, c, t, g, unknown or other
  misc_feature (281)..(284): n is a, c, g, or t

SEQ ID NO: 263886 - DNA, 285 bp, Homo sapiens
  misc_feature: GYAE6OF01C4YJR.24.53.E09.1.454.CMB.1.raw
  modified_base (282)..(285): a, c, t, g, unknown or other
  misc_feature (282)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtctgagcgggctggcaaggcgcatagnnnn

SEQ ID NO: 263887 - DNA, 462 bp, Homo sapiens
  misc_feature: GYAE6OF01B87DK.24.53.E09.1.454.CMB.1.raw
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (431)..(433): a, c, t, g, unknown or other
  misc_feature (431)..(433): n is a, c, g, or t
  modified_base (435)..(462): a, c, t, g, unknown or other
  misc_feature (435)..(462): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctcgtggggtccctgaccgattctccgcctccaagtctggcacctcacgcctcgctggccatcacgtgggcctccaggctgaggatgagggtgattactactgccngtcgcgaangtgtcggcggagggactaagctagccgtctaggcagccaagctcgcccctgtcnctctcgttcccnccctctcacngtagtgtcnggacgcggtctcggacgaacggcanatacgnnnannnnnnnnnnnnnnnnnnnnnnnnnnnn

SEQ ID NO: 263888 - DNA, 539 bp, Homo sapiens
  misc_feature: GYAE6OF01BK8L7.24.53.E09.1.454.CMB.1.raw
  modified_base (521)..(539): a, c, t, g, unknown or other
  misc_feature (521)..(539): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgcccccaaactcctcattttatcgtaaacaacaatccggccctctggggtccctgaccgattcctccgcctccaagtctggcacctcacgccctcgctggccatcacgtgggcctccgaggctaggaggatggagggtgatttacctacgtcgcctaggttccggtacgaagtagttcggttcgggacgggagggtactaaggcgtcggaccgtccgtaggtccacggaccccgaaggtccctccggcccccttcgggtacctaccttccgtacccgtttcccccaaccccgttccctacaactacgttaacggtcgtccgtgggacggcgggtcgtgggacgaaggccgacagtgnnnnnnnnnnnnnnnnnnn

SEQ ID NO: 263889 - DNA, 450 bp, Homo sapiens
  misc_feature: GYAE6OF01CYNI9.24.53.E09.1.454.CMB.1.raw
  modified_base (329)..(329): a, c, t, g, unknown or other
  misc_feature (329)..(329): n is a, c, g, or t
  modified_base (388)..(388): a, c, t, g, unknown or other
  misc_feature (388)..(388): n is a, c, g, or t
  modified_base (443)..(450): a, c, t, g, unknown or other
  misc_feature (443)..(450): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttaccaaaaaacagaccccccaaaatccctcatttatcgtaacaaacaatccggccctctggggtcccctgaccgattcctccgcctccaagtctggcacctcagcctcgctggccatcactgggctccaggctgaggatgagggtgattactactgccagtcgtcgaagatggttcggnggagggactaagctgaccgtcctaggtcagcccaaggctcgccccctggtccacttccncgttccccgcccctcctcactatagtagtctgagcgggctggcaaggcgcatagnnnnnnnn

SEQ ID NO: 263890 - DNA, 286 bp, Homo sapiens
  misc_feature: GYAE6OF01EI9QJ.24.53.E09.1.454.CMB.1.raw
  modified_base (281)..(286): a, c, t, g, unknown or other
  misc_feature (281)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnnnnn

SEQ ID NO: 263891 - DNA, 612 bp, Homo sapiens
  misc_feature: GYAE6OF01C5FQ3.24.53.E09.1.454.CMB.1.raw
  modified_base (305)..(305): a, c, t, g, unknown or other
  misc_feature (305)..(305): n is a, c, g, or t
  modified_base (572)..(572): a, c, t, g, unknown or other
  misc_feature (572)..(572): n is a, c, g, or t
  modified_base (575)..(576): a, c, t, g, unknown or other
  misc_feature (575)..(576): n is a, c, g, or t
  modified_base (579)..(579): a, c, t, g, unknown or other
  misc_feature (579)..(579): n is a, c, g, or t
  modified_base (583)..(612): a, c, t, g, unknown or other
  misc_feature (583)..(612): n is a, c, g, or t
tcagactactatgtcacgaccggtgctcgatttagagagagtgtgttgggtttgggggtgtttttggaagctgcttgtaccagagggtcaccatctcctgcactgggagcaacatcggcgcaggttttgatgtccactggtacaagcagcttccaaaaacacgcccccaaactcctcatttatcgtaacaacaatcggcccttctggggtccctgaccgattcctccgccctccaagtctggccacctcacgcctcgctggccagtcacgtgggcctccgaggcctggaggtagtggaaggggtntaatttacgtaccgtgcctaggtccgtaggaacgtagttggttccgggacgggaagggtaccttaaaggccgttacggacccggttaccgtaggtcccaacggccccgaaagggtccctacccggtcccccccgttacgggttccaacccgttccgttacccgtttcccccccgccccttccccgtactaacctacgttacggttaacgtccgttacgggacgggtccggggtcgtacgggaccgaaacgggccgactaacgtagcncanncgnacgnnnnnnnnnnnnnnnnnnnnnnnnnnnnnn

SEQ ID NO: 263892 - DNA, 512 bp, Homo sapiens
  misc_feature: GYAE6OF01CCE04.24.53.E09.1.454.CMB.1.raw
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (476)..(476): a, c, t, g, unknown or other
  misc_feature (476)..(476): n is a, c, g, or t
  modified_base (478)..(512): a, c, t, g, unknown or other
  misc_feature (478)..(512): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagcttaccaaaaaacncgaccccccaaactcctcattttanccgtaaacaacaatccggccctctcggggtccctgaccgattcctccgcctcaagtctggccacctcagcctcgctggccatccagtgggcctccgaggctgaggatgagggtnattacactgccagtcgnaagatgtcggcggaggactaagctgaccgtctaggcacgcccgaagtctccgccccctggcacctcgttccggttccccgacccttcctcaacgtacttaaggttacgtccgtaggacggccgggtctacgggacaaacggggcctacgagttacgngnnnnnnnnnnnnnnnnnnnnnnnnnnnnnnnnnnn

SEQ ID NO: 263893 - DNA, 484 bp, Homo sapiens
  misc_feature: GYAE6OF01BHAF0.24.53.E09.1.454.CMB.1.raw
  modified_base (111)..(111): a, c, t, g, unknown or other
  misc_feature (111)..(111): n is a, c, g, or t
  modified_base (165)..(165): a, c, t, g, unknown or other
  misc_feature (165)..(165): n is a, c, g, or t
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
  modified_base (443)..(444): a, c, t, g, unknown or other
  misc_feature (443)..(444): n is a, c, g, or t
  modified_base (446)..(447): a, c, t, g, unknown or other
  misc_feature (446)..(447): n is a, c, g, or t
  modified_base (449)..(451): a, c, t, g, unknown or other
  misc_feature (449)..(451): n is a, c, g, or t
  modified_base (455)..(458): a, c, t, g, unknown or other
  misc_feature (455)..(458): n is a, c, g, or t
  modified_base (460)..(464): a, c, t, g, unknown or other
  misc_feature (460)..(464): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(471): a, c, t, g, unknown or other
  misc_feature (470)..(471): n is a, c, g, or t
  modified_base (473)..(477): a, c, t, g, unknown or other
  misc_feature (473)..(477): n is a, c, g, or t
  modified_base (479)..(484): a, c, t, g, unknown or other
  misc_feature (479)..(484): n is a, c, g, or t
tcagactactatgtcacgaccggtgctcgatttagagagagtgtgttggagtttgggggctgtttttggaagctgcttgtaccagagggtcaccatctcctgcactgggancaaaccatcggcgcaggttttgatgtccactggtacaagcagcttccaaaaacngcccccaaatcctcatttatcgttaacaacaatcggccctctggggtcccctggaccgattcgtccgcctccaagtctggccaacctcagcctcgctggccatcactgggctccaggctgacgatgagggtgattactactgccagtcgtcgaagntgttcggcgggaggactaagctgaccgtcctagtcagccaaggctcgcccctgtcactcncgttccccacctcctcacntagtacgtctcggaggcgggctgggacaacgggcacgagtagnngnngnnntgcnnnncnnnnncncngnncnnnnncnnnnnn

SEQ ID NO: 263894 - DNA, 468 bp, Homo sapiens
  misc_feature: GYAE6OF01BVKC9.24.53.E09.1.454.CMB.1.raw
  modified_base (450)..(468): a, c, t, g, unknown or other
  misc_feature (450)..(468): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactggctccaggctgaggatgagggtgattacactgccagtcgtcgaagtatggttcggcggagggactaagctacggacctcctaggtcagccccgaaggcctccgccccctcggtccacgtcctcgttccccaccccttcctcacatagtacgtcgtgacggcgggctggacgaggcgcagtacgnnnnnnnnnnnnnnnnnnn

SEQ ID NO: 263895 - DNA, 444 bp, Homo sapiens
  misc_feature: GYAE6OF01DWI10.24.53.E09.1.454.CMB.1.raw
  modified_base (433)..(444): a, c, t, g, unknown or other
  misc_feature (433)..(444): n is a, c, g, or t
tcagactactatgtcacgaccggtgctcgatttagagagagtgtgttgggtttgggggctgtttttggaagctacttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtgattactactgccagtcgtcgaagatggttcgggcggagggactaagctgaccgtcctaggtcagcccaaggctcgccccctcggtcactctcgtcccaccctcctcacatgtagtctgacgcgggctggcaaggcgacatagnnnnnnnnnnnn

SEQ ID NO: 263896 - DNA, 504 bp, Homo sapiens
  misc_feature: GYAE6OF01DL1UC.24.53.E09.1.454.CMB.1.raw
  modified_base (164)..(164): a, c, t, g, unknown or other
  misc_feature (164)..(164): n is a, c, g, or t
  modified_base (292)..(293): a, c, t, g, unknown or other
  misc_feature (292)..(293): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (473)..(504): a, c, t, g, unknown or other
  misc_feature (473)..(504): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgctaggttttgatgtccactggtacaagcagcttaccaaaaacncgacccccaaactcctcatttatacgtaaacaacaactccggccctcgtcggggtccctgaccgattcctccgcctcaagtctggccacctcacgcctcgctggccatcacgtggctccgagctgagnngaggnatactncgacagtcgtcgaagnttcggtcggacggagggactaagctacgccgtctaggcacgcccgaagtcctccgtacccctggtccactcgttcgttcccccgccttcctacacgtacgtacggtacgtcgtacggacggtcgggcgtagggacccgaagggccacagagtnnnnnnnnnnnnnnnnnnnnnnnnnnnnnnnn

SEQ ID NO: 263897 - DNA, 283 bp, Homo sapiens
  misc_feature: GYAE6OF01A9T2P.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttcccaccctcctcacatagtagtctgagcgggctggcaaggcgcatagnn

SEQ ID NO: 263898 - DNA, 513 bp, Homo sapiens
  misc_feature: GYAE6OF01DWXTU.24.53.E09.1.454.CMB.1.raw
  modified_base (163)..(163): a, c, t, g, unknown or other
  misc_feature (163)..(163): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (484)..(513): a, c, t, g, unknown or other
  misc_feature (484)..(513): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngaccccccaaactcctcattttatcgtaaacaacaatcggccctcgtcggggtccctgaccgtattcctccgcctccaagtctggccacctcagcctcgctggccatcacgtggctccaggctggaggntggaggtnattactactcgcagtcgtacgaagtagtcggtcgggcggaggtactaagcgtacggacccgtcgtaggccacgacccgaggcctcccgcccctggcctacctcgtccgtccccctacccgtctacgaactagttacgtcgtcgtggacggtccgggagtcggacgtaacgggccacgtatacgnnnnnnnnnnnnnnnnnnnnnnnnnnnnnn

SEQ ID NO: 263899 - DNA, 392 bp, Homo sapiens
  misc_feature: GYAE6OF01DC5MG.24.53.E09.1.454.CMB.1.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
  modified_base (384)..(392): a, c, t, g, unknown or other
  misc_feature (384)..(392): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtnattactatgccagtcgtcgaagatggttcggcgggagggactaagctgaccgtcctaggtccacgcccaaggcctcgcccctcggtccactctgttcccactcctccncacatagtagtctgagcgggctggacaaggcgcagtagnnnnnnnnn

SEQ ID NO: 263900 - DNA, 306 bp, Homo sapiens
  misc_feature: GYAE6OF01CLEC3.24.53.E09.1.454.CMB.1.raw
  modified_base (277)..(277): a, c, t, g, unknown or other
  misc_feature (277)..(277): n is a, c, g, or t
  modified_base (284)..(306): a, c, t, g, unknown or other
  misc_feature (284)..(306): n is a, c, g, or t
tcagactactatgtcacgaccggtgctcgatttagagagagtgtggttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttcccgccctcctcacatagtagtctgagcgggtctggcaaggcncaatagnnnnnnnnnnnnnnnnnnnnnnn

SEQ ID NO: 263901 - DNA, 442 bp, Homo sapiens
  misc_feature: GYAE6OF01DECAZ.24.53.E09.1.454.CMB.1.raw
  modified_base (163)..(163): a, c, t, g, unknown or other
  misc_feature (163)..(163): n is a, c, g, or t
  modified_base (436)..(442): a, c, t, g, unknown or other
  misc_feature (436)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaaactcctcatttatcgtaacaacaatcggccctctggggtcccctgaccgactctccgcctccaagtctggcacctcagcctcgctggccatcactgggctccaggctgaggatgagggtgattactactgccagtcgtacgaagatggttcgggcggagggactaagctgaccgtctaggtcagcccaaggctcgcccctggtcactctcgttccccaccctctcacatagtagtctgagcgggctggcaaaggcgacatagnnnnnnn

SEQ ID NO: 263902 - DNA, 282 bp, Homo sapiens
  misc_feature: GYAE6OF01CE9OU.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnn

SEQ ID NO: 263903 - DNA, 598 bp, Homo sapiens
  misc_feature: GYAE6OF01DH44W.24.53.E09.1.454.CMB.1.raw
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (570)..(573): a, c, t, g, unknown or other
  misc_feature (570)..(573): n is a, c, g, or t
  modified_base (575)..(575): a, c, t, g, unknown or other
  misc_feature (575)..(575): n is a, c, g, or t
  modified_base (577)..(598): a, c, t, g, unknown or other
  misc_feature (577)..(598): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctcggggtccctggaccgattcctccgcctccaagtctggccacctcagcctcgctggccatcacgtcgggctccgaggctggacggtatggagggtgaatttactactcgccgaggtcgtaccgaagtacgtggttcggacggacgggtactaagctacgaccgtacgtaggtccacggaccccgaaaggtcccgtaccggtccccccgttacggtccctaccgttcccgttccggtttaccccccaacccccgttcctaccgacctaacgtttaacggttaacggttcctacgggaacgggtcccggggtacgttgggaaccgaaaggggtcccgaactacgttaacggnacgctgcngcgngcnnnncncnnnnnnnnnnnnnnnnnnnnnn

SEQ ID NO: 263904 - DNA, 492 bp, Homo sapiens
  misc_feature: GYAE6OF01AFPW1.24.53.E09.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
  modified_base (474)..(492): a, c, t, g, unknown or other
  misc_feature (474)..(492): n is a, c, g, or t
tcagactactatgtcacgaccggtgctcgatttagagagagtgtgttgggtttgggggctgttttggaagctgcttgtaccagagggtcaccatctcctgcactgggagcaacattcggcgctaggttttgatgtccactggtacaagcagcttaccaaaaacncgcccccaaatcctcatttancgtaacacaatcggccctgtcggtccngacgtctcgccgcctacagtcgtcgcctacctcacgcctcgcgtcgcctatccnggtcggcctcgagtctaggagngtggaggtntaacttactacncgaccgtagtcgagaagtgttcggtcggacggtagaactacgtctacggccgtacgtacgccgaccgaccgaggtccctccccgtcccgtgtacctacttccgtccctccccaccttcacactaagtcgtntcgaggcggtcggtcgcggaacgcggaccnaagnnnnnnnnnnnnnnnnnnn

SEQ ID NO: 263905 - DNA, 651 bp, Homo sapiens
  misc_feature: GYAE6OF01DDRDM.24.53.E09.1.454.CMB.1.raw
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgtgggggggtccctggagacctctcctgtgcagcctctggtacttcccctttagtcgtacttttggatgaccgtgggtccgccgaggctccgaggggcgggctgggaggtgggtcgaccaagtataaggcacgatggacgtagcagtgtactagtggtagacttcgtgtaggaacgggccgtattaccaaccctacttacctaccgaaggaacgaaccgaaaccgaccccaaggtaaccctacgtaaccttgtaacttcgttaacggaaacttcggaaccctaacggtacccgttaggaacggtaggtaccggaacggaaccgtacgggtaccttaagttagttaactttacgtcggtacgaccggtaacctaattaaccgtacaccgtacctaacccgtgggacgtccgcgtaacg

SEQ ID NO: 263906 - DNA, 309 bp, Homo sapiens
  misc_feature: GYAE6OF01EOHM9.24.53.E09.1.454.CMB.1.raw
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (302)..(309): a, c, t, g, unknown or other
  misc_feature (302)..(309): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgtattactactgccagtcgtacgaagatggttcggcggaggactaagctcgaccgtccgtaggtcacgacccgaaggcctccgcccccgttcggtccacttcctcgttccccaccctcctcacatagtagtcgtgaggcggcgtggacgacggcnanagnnnnnnnn

SEQ ID NO: 263907 - DNA, 585 bp, Homo sapiens
  misc_feature: GYAE6OF01D7CV6.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccgagggacggggctggagtgggtggccaatataaggcacgatggacgtagcatgtactatgtggactctgtgaaggccgattcaccatctccagagacaacgcccagaactcactgtatctggaaatgaccagcctgagagtcgaggacacggctatgtattactgtgcgaccatatcagcaccgtggacgtcgcatctagaacttacttccagctagttcggggccacgggccacccgtggtaccacccgtctcctcacgcctaccaccgaacgggccctacgtccggttcccttcccccgtcggccgtcccctgccctaccgacggacgccacccgtccgacgacgccaacgacggccggcccgtcgggccgtcggtccgtcggtccgaaacggtaccctaaccttccaactatacggttagtcgtacggg

SEQ ID NO: 263908 - DNA, 455 bp, Homo sapiens
  misc_feature: GYAE6OF01CDIN5.24.53.E09.1.454.CMB.1.raw
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
  modified_base (435)..(455): a, c, t, g, unknown or other
  misc_feature (435)..(455): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctcgtggggtccctgaccgattcctccgcctccaagtctggcacctcagcctcgctggccatcactgggctccgaggctgagatgagggtnattactactgccagtcgtcgaagagtgtcggcggagggactaagctgaccgtcctaggtcacgccaaggcncgcccctggtcactctcgtccccaccctcctcactatacgtagtcgtgacgcggctggcgaggcgcagtagnnnnnnnnnnnnnnnnnnnnn

SEQ ID NO: 263909 - DNA, 440 bp, Homo sapiens
  misc_feature: GYAE6OF01EJCUF.24.53.E09.1.454.CMB.1.raw
  modified_base (424)..(424): a, c, t, g, unknown or other
  misc_feature (424)..(424): n is a, c, g, or t
  modified_base (430)..(440): a, c, t, g, unknown or other
  misc_feature (430)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcattttatcgtaacaacaatcggccctctggggtccctgaccgattctccgcctccaagtctggcacctcagccctcgctggccatcactgggcctccaggctgaggatggaggtgattactactgccagtcgtcgaagatggtcggcggaggactagctgaccgtctagcacgccaaggctcgcccctgtcactctcgtccccacctcctcacatagtacgtctggagcgggctggacgaaggcncatagnnnnnnnnnnn

SEQ ID NO: 263910 - DNA, 314 bp, Homo sapiens
  misc_feature: GYAE6OF01AGJ1S.24.53.E09.1.454.CMB.1.raw
  modified_base (280)..(280): a, c, t, g, unknown or other
  misc_feature (280)..(280): n is a, c, g, or t
  modified_base (286)..(314): a, c, t, g, unknown or other
  misc_feature (286)..(314): n is a, c, g, or t
tcagactactatgtcacgaccggtgctcgatttagagagagtgtgttgggtttgggggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaaggctcgccccctcggtcactctgttccccgccctcctcacatagtacgtctgagcgggctggcaaggcncatagnnnnnnnnnnnnnnnnnnnnnnnnnnnnn

SEQ ID NO: 263911 - DNA, 302 bp, Homo sapiens
  misc_feature: GYAE6OF01EDQ3N.24.53.E09.1.454.CMB.1.raw
  modified_base (284)..(302): a, c, t, g, unknown or other
  misc_feature (284)..(302): n is a, c, g, or t
tcagactactatgtcacgaccggtgctcgatttagagagagtgtgttggggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctcgccccctgtcactctcgttccccgccctcctcacatagtagtctgagcgggcttgggcaagggcgcatacgnnnnnnnnnnnnnnnnnnn

SEQ ID NO: 263912 - DNA, 516 bp, Homo sapiens
  misc_feature: GYAE6OF01AXRKH.24.53.E09.1.454.CMB.1.raw
  modified_base (283)..(285): a, c, t, g, unknown or other
  misc_feature (283)..(285): n is a, c, g, or t
  modified_base (287)..(288): a, c, t, g, unknown or other
  misc_feature (287)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgcccctcggtcactctcgttcccgcctcctcacatacgtagtctgacgcgggctggcaacggcgcatagnnngnncncncncgcgcncgcgtcgcncgcncncgncgngcgncgnacngacncngcncgcgcncgcncacgtcgctacgtcgtacgcgtacgtcgacgcgcgacncgcgtcncgcgtacgcgtcgcgtacgcgtaccgagtccgagtacggtccacggtccgtacncggtaccncggtccacgtaccgcaccggtcgtcgaccgtcgacgtacgcgacgtcgcgtacgtccgg

SEQ ID NO: 263913 - DNA, 474 bp, Homo sapiens
  misc_feature: GYAE6OF01BO2CB.24.53.E09.1.454.CMB.1.raw
  modified_base (458)..(474): a, c, t, g, unknown or other
  misc_feature (458)..(474): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttaccaaaaacacgcccccaaactcctcatttatcgtaacaacaatccggccctcgtcggggtcccctgaccgattcctccgcctccaagtctggccacctcacgcctcgctggccatcactgggctccaggctgaggatggagggtgattactactgccagtcgtcgaagatgttcgggcggaggactaagctcgaccgtcctaggtcagcccaaggcctcgccccctcggtcacctccgtcgttccccgccctcctcacatacgtcgtctggacggcgggactcgggacgaaggccacagtagcnnnnnnnnnnnnnnnnn

SEQ ID NO: 263914 - DNA, 280 bp, Homo sapiens
  misc_feature: GYAE6OF01EC1QW.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctgttcccaccctcctcacatagtagtctgagcgggctggcaaggcgcatagnnn

SEQ ID NO: 263915 - DNA, 282 bp, Homo sapiens; identical to SEQ ID NO: 263835
  misc_feature: GYAE6OF01B1WDJ.24.53.E09.1.454.CMB.1.raw
  modified_base (281)..(282): a, c, t, g, unknown or other
  misc_feature (281)..(282): n is a, c, g, or t

SEQ ID NO: 263916 - DNA, 282 bp, Homo sapiens
  misc_feature: GYAE6OF01AQE2E.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctgttccccgccctcctcacatagtagtctgagcgggctggcaaggcgcatagnn

SEQ ID NO: 263917 - DNA, 284 bp, Homo sapiens
  misc_feature: GYAE6OF01C4H9O.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttcccaccctcctcacatagtagtctgagcgggctggcaaggcgcatagnnnn

SEQ ID NO: 263918 - DNA, 543 bp, Homo sapiens
  misc_feature: GYAE6OF01BUKKG.24.53.E09.1.454.CMB.1.raw
  modified_base (166)..(166): a, c, t, g, unknown or other
  misc_feature (166)..(166): n is a, c, g, or t
  modified_base (510)..(543): a, c, t, g, unknown or other
  misc_feature (510)..(543): n is a, c, g, or t
tcagactactatgtcacgaccggtgctcgatttagagagagtgtgttgggtttgggggctgtttttggaagctgcttgtaccagagggtcaccatctttcctgcactgggagcaacatcggcgcaggttttgatgtccactggtacaagcagcttaccaaaaaacncgaccccccaaaactccctctattttatccgtaaacaacaatccggcccttcgtcggggtccctgaccgattctccgcctccaagtctggccacctcacgcctcgctggcctatcgacgtgggaccttccgaggctggaggatggaggtgattacctatgacccagtcgtacgaagtagtcggttcgggacggagggacctaggctacgaccgtctaggtccagcccaaggtcccgtaccgcccccgttggccacgttccgttaccgttcccccgccctcgtacacctagtagtacgtcgtaggcggccgggtcgtcggacgaacgggcgccgtaaagcggtannnnnnnnnnnnnnnnnnnnnnnnnnnnnnnnnn

SEQ ID NO: 263919 - DNA, 590 bp, Homo sapiens
  misc_feature: GYAE6OF01CF44C.24.53.E09.1.454.CMB.1.raw
  modified_base (163)..(163): a, c, t, g, unknown or other
  misc_feature (163)..(163): n is a, c, g, or t
  modified_base (302)..(302): a, c, t, g, unknown or other
  misc_feature (302)..(302): n is a, c, g, or t
  modified_base (559)..(590): a, c, t, g, unknown or other
  misc_feature (559)..(590): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngcccccaaaactcctcatttatccgtaaacaacaatccggccctcgtcggggtccctgaccgattcctccgcctccaagtctggcacctcacgcctcgctggcccatcacgtgggcctccaggctgaggatggagggtnattactactgccagtcggtacgaagtagttcggttcgggcgggaagggactaaaggccgttacggacccgtccgtaagggtccaacggaccccgaaagggtccctcccggcccccctttgggtaccctaccgttcccgttaccgtttacccccccaaccccttccccgtaccaaccgtaagttacggtaccgttccgtacggacgggtccggggtcgtacggggacgaaacggggtccgacaacgttaagcagcgtnnnnnnnnnnnnnnnnnnnnnnnnnnnnnnnn

SEQ ID NO: 263920 - DNA, 298 bp, Homo sapiens
  misc_feature: GYAE6OF01D52GR.24.53.E09.1.454.CMB.1.raw
  modified_base (290)..(298): a, c, t, g, unknown or other
  misc_feature (290)..(298): n is a, c, g, or t
tcagactactatgtcacgaccggtgctcgatttagagagagtgtgttgggtttggggggtgtggtggtctccactcccgccttgacggggctgctatctgcctcgctggccatcactggctccaggctgaggatgagggtgattactactgccagtcgtacgaagatgttcggcggagggactaagctcgaccgtcctagtcagccaaggctcgcccctcgtcacttctcgttccccaccctcctacactatagtagtcgtgaggcgggtctggcgaaggcgacagtagnnnnnnnnn

SEQ ID NO: 263921 - DNA, 440 bp, Homo sapiens
  misc_feature: GYAE6OF01BVE9J.24.53.E09.1.454.CMB.1.raw
  modified_base (161)..(161): a, c, t, g, unknown or other
  misc_feature (161)..(161): n is a, c, g, or t
  modified_base (287)..(287): a, c, t, g, unknown or other
  misc_feature (287)..(287): n is a, c, g, or t
  modified_base (431)..(440): a, c, t, g, unknown or other
  misc_feature (431)..(440): n is a, c, g, or t
tcagactactatgtcacgaccggtgctcgatttagagagagtgtgttgggtttgggggtgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtnattactactgccagtcgtcgaagatgttcggcggagggactaagctgaccgtcctaggtcagcccaaggcctcgccccctggtcactcctcgtccccacctcctcactatacgtgtctgacgcggctggacaaggcgacatagnnnnnnnnnn

SEQ ID NO: 263922 - DNA, 304 bp, Homo sapiens
  misc_feature: GYAE6OF01BNNBT.24.53.E09.1.454.CMB.1.raw
  modified_base (283)..(304): a, c, t, g, unknown or other
  misc_feature (283)..(304): n is a, c, g, or t
tcagactactatgtcacgaccggtgctcgatttagagagagtgtgttggggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctgttccccgccctctcacatagtagtctgagccgggctggacaaggcgcatagnnnnnnnnnnnnnnnnnnnnnn

SEQ ID NO: 263923 - DNA, 486 bp, Homo sapiens
  misc_feature: GYAE6OF01DI1F3.24.53.E09.1.454.CMB.1.raw
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (399)..(399): a, c, t, g, unknown or other
  misc_feature (399)..(399): n is a, c, g, or t
  modified_base (459)..(486): a, c, t, g, unknown or other
  misc_feature (459)..(486): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaaacacgaccccccaaactcctcattttatcgtaacaacaatccggccctcgtcggggtccctgaccgattcncccgcctccaagtctggcacctcagcctgctggccatcactgggctccgaggctgaggatggagggtnattacactgccagtcgtacgaagngtgttcggcggaggactaagctgaccgtctagcacgcccgaaggcctcgccccctggtcacctcgtcgttaccccnccctcctacaactagtacgtacgtctaggcgccggggctgggacaagggtccacagtagnnnnnnnnnnnnnnnnnnnnnnnnnnnn

SEQ ID NO: 263924 - DNA, 476 bp, Homo sapiens
  misc_feature: GYAE6OF01DPBXU.24.53.E09.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (463)..(476): a, c, t, g, unknown or other
  misc_feature (463)..(476): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacagccccccaaaactccctcattttaatcgtaaacaacaatccggccctntcggggtccctgaccgattccnccgcctccaagtctggcacctcagcctcgctggccatcactcgggctccaggctgaggatgagggtgattactactgccagtcgtcgaagntgttcggcggagggactaagctcgaccgtccgtaggtcacgcccgaacggctccggtcccccctcggtcaccgtctcgttcccccgccctccctcacatagttacgtctgaggcgggcgtcggacaaggccgctatagnnnnnnnnnnnnnn

SEQ ID NO: 263925 - DNA, 286 bp, Homo sapiens
  misc_feature: GYAE6OF01DJP1I.24.53.E09.1.454.CMB.1.raw
  modified_base (284)..(286): a, c, t, g, unknown or other
  misc_feature (284)..(286): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatagnnn

SEQ ID NO: 263926 - DNA, 294 bp, Homo sapiens
  misc_feature: GYAE6OF01DZBR3.24.53.E09.1.454.CMB.1.raw
  modified_base (287)..(294): a, c, t, g, unknown or other
  misc_feature (287)..(294): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaaggcctcgcccctggtcactctcgttcccaccctcctacaatacgtagtctgacgcgggctggacaaggcgacatagnnnnnnnn

SEQ ID NO: 263927 - DNA, 287 bp, Homo sapiens
  misc_feature: GYAE6OF01BZABO.24.53.E09.1.454.CMB.1.raw
  modified_base (283)..(287): a, c, t, g, unknown or other
  misc_feature (283)..(287): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatggagggtgattactactgccagtcgtcgaagatgttcggcggatggactaagttgaccgtcctaggtcagcccaaggctcgcccctcggtcactctcgttcccgccctcctcacatagtagtctgagcgggctggacaaggcgacatagnnnnn

SEQ ID NO: 263928 - DNA, 285 bp, Homo sapiens; identical to SEQ ID NO: 263817
  misc_feature: GYAE6OF01B773P.24.53.E09.1.454.CMB.1.raw
  modified_base (283)..(285): a, c, t, g, unknown or other
  misc_feature (283)..(285): n is a, c, g, or t

SEQ ID NO: 263929 - DNA, 723 bp, Homo sapiens
  misc_feature: GYAE6OF01DTCOK.24.53.E09.1.454.CMB.1.raw
  modified_base (632)..(632): a, c, t, g, unknown or other
  misc_feature (632)..(632): n is a, c, g, or t
tcagactactatgtcacgaccggtgctcgatttagagagagtgtggttggggttgggggctgttttggaagctgcttgtaccagagggtaccaccatctcctgcactgggagcaaacatcggcgctagggttttgatgtcctacttgggtacaagcagcttaccaaaaacacgacccccaaactcctctaatttatcgtaacaactaatcggccctcgtcggggtccctgaccgattcctccgcctccgaagttcctggcacctcgacgcctcggctacggtccctatccgacgtcgggtaccttcccgaggtacttaggaacggtagtagggacggggttctaaactttaaccgtacggtccgccggtacggttaccgtaccggtaaaggtagttcgggttacgggacgggtaagggtaacgtaacgcgtaccggtaccgtacgttagggtacaacggccgtaaacggtccttccggtaccccccttagggtaccctaccgttcgttacccgttacccccgtacccttacctacaaccgttaacgtaacgttaccgttacgtaacgtaacgggaccgggtacgttcgggaaccgtaacgggtaccgagttaacgtacggtgactgacgtanactcgactacgacgactgtactcgtacgtgacgcgatacgacgtacgtcgacgcgtcgacgtacgacgtcgtacgtacgtcgtcgtcgtcg

SEQ ID NO: 263930 - DNA, 753 bp, Homo sapiens
  misc_feature: GYAE6OF01DGZEM.24.53.E09.1.454.CMB.1.raw
  modified_base (238)..(238): a, c, t, g, unknown or other
  misc_feature (238)..(238): n is a, c, g, or t
  modified_base (609)..(609): a, c, t, g, unknown or other
  misc_feature (609)..(609): n is a, c, g, or t
  modified_base (618)..(618): a, c, t, g, unknown or other
  misc_feature (618)..(618): n is a, c, g, or t
  modified_base (625)..(625): a, c, t, g, unknown or other
  misc_feature (625)..(625): n is a, c, g, or t
tcagactactatgtcacgaccggtgctcgatttagagagagtgtgttgggttgggggctgttttggaagctgcttgtaccagagggtcacatctcctgcactgggagcaacatcggcgcaggtttgatgtccactggtacaagtcagtcttaccaaaaaactgcccccctaaaatccctatattttaactacgtaaacaacaattccggcccctgggtccggtccgacgactcttccnccgtcctaacgtacgtcgcgacctacctacgtcctccgtcgtcgtaccgacctactaccgtagggtccgtcctaaccggaggtcgtaaggaacggtagtagggtacggtacttaacgttaaccgtcgtaccgaacgtaccggtaggaacgtaaggtcgttcggggtacgggacggtaacggtaaatcgtcgtaccgtaccgttaggtacgtacgaccggtaacgtacgtccgtaccccgtcccggttaagcctacgttccggtacccgtacccccacgttaccgtaactaacgtttacgtaagggttccctcggtaaccggaggggtaccccgttagaccgaaaccggaacgggcctaagttaaggtaccnctagactanacgtacncggaattcgaaggtactcgtacgtacgtacgtacgtacgtacggtacggtacggtacggtaacgtaacggtaacggtacgtacgtaacgtaacgtaacgtacgtacgtacgtacgtacgtacggtacg

SEQ ID NO: 263931 - DNA, 720 bp, Homo sapiens
  misc_feature: GYAE6OF01A1LY1.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtacttttggatgacctgggtccgccaggctccgaggggacgggctggagtgggtggccaatataaggcacgatggacgtagcatgtactatgtggactctgtgaagggccattcaccatctccagagacaacgcccagaactcactgtatctaggaaatgaccagcctgagagtcggaggacacggctagtgtaattactgtgaccgaccatactcagcaccgtggacgtcgactatctagaacttacttaccagtctaggttcggggaccctacggggccctacccgttcggtacccgtacccggttccttacccctacgtacccgtaccccgttacccgaaacccggtaaccgggtccccctaacggttccccgggtttacccccgtttcccccccgttgggcccccgtcccccgtcggtcccgttaccccgaacgggtacccgacccgtaaccccgtaccggaacgaccgacccgaaccgaccgggaccccgggtccccggtccggggccgttccggtacccggttacgggtaaccgaaccgggttaacccttacccgtttacccaacttaacggttacgttacgttcggtacggg

SEQ ID NO: 263932 - DNA, 567 bp, Homo sapiens
  misc_feature: GYAE6OF01DQPSQ.24.53.E09.1.454.CMB.1.raw
  modified_base (163)..(163): a, c, t, g, unknown or other
  misc_feature (163)..(163): n is a, c, g, or t
  modified_base (306)..(306): a, c, t, g, unknown or other
  misc_feature (306)..(306): n is a, c, g, or t
  modified_base (541)..(541): a, c, t, g, unknown or other
  misc_feature (541)..(541): n is a, c, g, or t
  modified_base (544)..(567): a, c, t, g, unknown or other
  misc_feature (544)..(567): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgccccccaaaactcctcattttatcgtaaacaacaatcggccctcgtcggggtccctgaccgattcctcccgcctccaagtctggccacctcagccctcgctcggccatcacgtgggctccgaggctggaggatggagggtnacttactactcgcctaggtccgtacgaagtgttcgggtccgggacgggaaggtacctaagccgttacggtaaccccgtccgttaaggccaaccggaccccgaagggtccctccccggccccccgttcggtacctacccgttcgttacccgttcccccaacccccttcctaccaacgttattacggttacgtcttcggacggtcggggctagggaccgtaacggccgactaagtgncgnnnnnnnnnnnnnnnnnnnnnnnn

SEQ ID NO: 263933 - DNA, 284 bp, Homo sapiens
  misc_feature: GYAE6OF01AZ45R.24.53.E09.1.454.CMB.1.raw
  modified_base (280)..(284): a, c, t, g, unknown or other
  misc_feature (280)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnn

SEQ ID NO: 263934 - DNA, 435 bp, Homo sapiens
  misc_feature: GYAE6OF01EBQVM.24.53.E09.1.454.CMB.1.raw
  modified_base (428)..(435): a, c, t, g, unknown or other
  misc_feature (428)..(435): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggccatcactggctccaggctgaggatgagggtgattactactgccagtcgtcggaagatgttcggcggagggactaaggctggaccgtctaggtcagcccaaggctgccccctggtcactctcgttcccgcctcctcactatagtagtctgagcgggtctggcaaggccgcatgnnnnnnnn

SEQ ID NO: 263935 - DNA, 288 bp, Homo sapiens
  misc_feature: GYAE6OF01AMWX0.24.53.E09.1.454.CMB.1.raw
  modified_base (283)..(288): a, c, t, g, unknown or other
  misc_feature (283)..(288): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttccccgccctcctcacatagtagtctgagcgggctggcaaggcgacatagnnnnnn

SEQ ID NO: 263936 - DNA, 284 bp, Homo sapiens
  misc_feature: GYAE6OF01ET2E4.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctgttctcaccctcctcacatagtagtctgagcgggctggcaaggcgcatagnnnn

SEQ ID NO: 263937 - DNA, 506 bp, Homo sapiens
  misc_feature: GYAE6OF01CGBCE.24.53.E09.1.454.CMB.1.raw
  modified_base (163)..(163): a, c, t, g, unknown or other
  misc_feature (163)..(163): n is a, c, g, or t
  modified_base (291)..(291): a, c, t, g, unknown or other
  misc_feature (291)..(291): n is a, c, g, or t
  modified_base (487)..(506): a, c, t, g, unknown or other
  misc_feature (487)..(506): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaatcctcatttatcgtaacaacaatcggccctcgtggggtccctgaccgattcctccgcctccaagtctggcacctcagcctcgctggccatcactgggctccaggctgaggatgagggtnattactactgccagttcgtcgaaagtagttggtcgggagggaacggtaactaacggctacggacccgttacgtaggaccaaccgaccgaagccgtcccgcccccgttggcctaccttcgttccttacccccaacccttcctacaactagttacgtacgtctggacggcgggtcgtcggacgaaggccgatagtagnnnnnnnnnnnnnnnnnnnn

SEQ ID NO: 263938 - DNA, 831 bp, Homo sapiens
  misc_feature: GYAE6OF01A498P.24.53.E09.1.454.CMB.1.raw
  modified_base (162)..(162): a, c, t, g, unknown or other
  misc_feature (162)..(162): n is a, c, g, or t
  modified_base (784)..(784): a, c, t, g, unknown or other
  misc_feature (784)..(784): n is a, c, g, or t
  modified_base (788)..(788): a, c, t, g, unknown or other
  misc_feature (788)..(788): n is a, c, g, or t
  modified_base (805)..(805): a, c, t, g, unknown or other
  misc_feature (805)..(805): n is a, c, g, or t
  modified_base (807)..(807): a, c, t, g, unknown or other
  misc_feature (807)..(807): n is a, c, g, or t
  modified_base (809)..(810): a, c, t, g, unknown or other
  misc_feature (809)..(810): n is a, c, g, or t
  modified_base (812)..(831): a, c, t, g, unknown or other
  misc_feature (812)..(831): n is a, c, g, or t
tcagactactatgtcacgaccggtgctcgatttagagagagtgtgttgagtttggggctgttttggaagctgcttgtaccagagggtcaccatctcctgcactgagagcaacatcggcgcaggttttgatgtccactggtacaagcagcttaccaaaaaacncgacccccaaactcctacctatttactacgtaaacaactaatccggcccttcgtggggtcccctagacccgtatttcccgtcccgccttaccaaacggttctcggacctaaccctcacgcccttccggccttcggggaccaattcctaccgttcggggcttcccgaaggccctaggaaggacgtacgggtaggggttacgaatttaaaccgttccgttacgggacccgttaaggttccgggttaacggtaaaaggtacgttttccggggtttccgggggaacccggggaaaggggttaaaccgttaaaacgggtcccgtttaccggggtaaaacccccgggttttccgtaaacgggggtttaccctaaaccggggtaacccccccggaaagggggtcccctttaaccccgggccccccccggttttacgggttaccccttaaacccgttttccccggtttccggttttttaaccccccccaaaccccccgggtttccgttaacccctaaaccgtttaaaccggtttacccgggtaaaccggttttcccggtttacggggacccggttaccgggccggtttaaccgggaccggtaaaccgggcccgtaacgtaacgaacggtnacgngacgcgtcgcacgctcncncnncnnnnnnnnnnnnnnnnnnnn

SEQ ID NO: 263939 - DNA, 294 bp, Homo sapiens
  misc_feature: GYAE6OF01EGIIN.24.53.E09.1.454.CMB.1.raw
  modified_base (288)..(288): a, c, t, g, unknown or other
  misc_feature (288)..(288): n is a, c, g, or t
  modified_base (290)..(294): a, c, t, g, unknown or other
  misc_feature (290)..(294): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagccaggctcgcccctcgtcactctcgttccccaccctcctacacattagtagtctaggacgcgggtctgggacaaggcgtcagtagnannnnn

SEQ ID NO: 263940 - DNA, 286 bp, Homo sapiens
  misc_feature: GYAE6OF01BT5WX.24.53.E09.1.454.CMB.1.raw
  modified_base (283)..(286): a, c, t, g, unknown or other
  misc_feature (283)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactcctcgttcccaccctcctcacatagtagtctgagcggctggacaaggcgcatagnnnn

SEQ ID NO: 263941 - DNA, 449 bp, Homo sapiens
  misc_feature: GYAE6OF01E1K1R.24.53.E09.1.454.CMB.1.raw
  modified_base (292)..(292): a, c, t, g, unknown or other
  misc_feature (292)..(292): n is a, c, g, or t
  modified_base (435)..(449): a, c, t, g, unknown or other
  misc_feature (435)..(449): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactcctcatttatcgtaacaacaatcggccctctggggtccctgaccgattctccgcctccaagtctggcacctcagcctcgctggccatcacgtgggctccaggctgaggatgagggtnattactactgccaggtcgtcgaagatgttcggcgggaggactaagctgaccgtctaggcagcccgaaggcctgccccctggtccactctcgtccccaccctctcacatagtagtctggagcgggctcggcaagggcgcagtgnnnnnnnnnnnnnnn

SEQ ID NO: 263942 - DNA, 694 bp, Homo sapiens
  misc_feature: GYAE6OF01BI2AT.24.53.E09.1.454.CMB.1.raw
  modified_base (134)..(134): a, c, t, g, unknown or other
  misc_feature (134)..(134): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (625)..(625): a, c, t, g, unknown or other
  misc_feature (625)..(625): n is a, c, g, or t
  modified_base (688)..(688): a, c, t, g, unknown or other
  misc_feature (688)..(688): n is a, c, g, or t
tcagactactatgtcacgaccggtgctcgatttagagagagtgtgttggggtttgggggctgttttggacgacctggcttagtaccagagggtcaccatctccgtcgcactggagcaacagtcgcgcaggtttnatggtccactggtaacaagccagcttaccgaaaaacacgacccccaaactcctactactttacctacgttaaccaaccaagtcccggtcccttcgttcggggtccctcgaccgtacttccgtccggacctaccgaaagtcgtcggacctacctcgacgtccgtcgcgtcggacctagtcgaacgtcgggtacctaccgacggtacttaggtaaggtgtacgtaggggtagtacttaaccgtacgtacggaccgtacggtaccgttacgaacgtagttcggtacggacgggaacggtacgtaacgcgttacggaccgtttacgtacgggtacgtaccggtacccaagggtcctaaccggtccccgtggtactacgtcgttcgggtcccctacctccgtactacttagttacgttactacgtacgtaacggtcggtacgtacggaacgacggtacgtacgtagtagacgtacanctgtntctanatatagtanatactactactactctcgtcgtacgacgtacgtagagtacgacgtacgacgtacgtacgagcncgcacg

SEQ ID NO: 263943 - DNA, 282 bp, Homo sapiens
  misc_feature: GYAE6OF01BJJ3I.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaagctgcccctcggtcactctcgttcccaccctcctcacatagtagtctgagcgggctggcaaggcgcatagnnn

SEQ ID NO: 263944 - DNA, 451 bp, Homo sapiens
  misc_feature: GYAE6OF01CQ0HP.24.53.E09.1.454.CMB.1.raw
  modified_base (162)..(162): a, c, t, g, unknown or other
  misc_feature (162)..(162): n is a, c, g, or t
  modified_base (225)..(225): a, c, t, g, unknown or other
  misc_feature (225)..(225): n is a, c, g, or t
  modified_base (446)..(451): a, c, t, g, unknown or other
  misc_feature (446)..(451): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcattttatcgtaacaacaatcggccctctggggtccctgaccgattcnccgcctccaagtctggcacctcagcctcgctggccatcactggctcaggctgagatgaggtgattactactgcctagtcgtacgaagtatcggttcgggcggaggggactaagctcgaccgtccgtaggtcacgcccaaggcctcgccccctggtcactcctcgttccccaccctcctcactattacgtagtctgacggcgggctgggcaaggcgcatagnnnnnn

SEQ ID NO: 263945 - DNA, 286 bp, Homo sapiens
  misc_feature: GYAE6OF01C1HFJ.24.53.E09.1.454.CMB.1.raw
  modified_base (278)..(278): a, c, t, g, unknown or other
  misc_feature (278)..(278): n is a, c, g, or t
  modified_base (284)..(286): a, c, t, g, unknown or other
  misc_feature (284)..(286): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttccccaccctcctcacatagtagtctggagcgggctggcaaggcncatagnnn

SEQ ID NO: 263946 - DNA, 285 bp, Homo sapiens
  misc_feature: GYAE6OF01BA2RH.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttcccacctcctcacatagtagtctgagcgggctggcaaggcgcatagnnnnnn

SEQ ID NO: 263947 - DNA, 618 bp, Homo sapiens
  misc_feature: GYAE6OF01BCH10.24.53.E09.1.454.CMB.1.raw
  modified_base (164)..(164): a, c, t, g, unknown or other
  misc_feature (164)..(164): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (592)..(593): a, c, t, g, unknown or other
  misc_feature (592)..(593): n is a, c, g, or t
  modified_base (595)..(597): a, c, t, g, unknown or other
  misc_feature (595)..(597): n is a, c, g, or t
  modified_base (599)..(601): a, c, t, g, unknown or other
  misc_feature (599)..(601): n is a, c, g, or t
  modified_base (603)..(612): a, c, t, g, unknown or other
  misc_feature (603)..(612): n is a, c, g, or t
  modified_base (614)..(618): a, c, t, g, unknown or other
  misc_feature (614)..(618): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgaccccccaaaactcctcattttactacgtaaacaacaaatccggccctcgtcgggggtccctggaccgatttcctcccgcctaccaaagtctcggccacctcagcctcgctggccatcactggctcgaggcngaggatggagggtnattactcgngccaggtccgagaagtgttcggtcgggacgggaagggactaaacggcgttacggacccgttccgtaacgggtccaacgcccgaaagggcccgttaccggccccccgttcgggtacctaaccttcccgttccgtcccccgtaccccttccctaccgtaactacgttaacggtacggttaccgtagggtaacggcccgggggtacccgtaggggaacccgaaacggggtcccgaacgtaacggtacggacgcgtacgacgncnnacncgngcnngnnngnnngnnnnnnnnnnannnnn

SEQ ID NO: 263948 - DNA, 280 bp, Homo sapiens
  misc_feature: GYAE6OF01EQ6IN.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnn

SEQ ID NO: 263949 - DNA, 473 bp, Homo sapiens
  misc_feature: GYAE6OF01C4C4Y.24.53.E09.1.454.CMB.1.raw
  modified_base (164)..(164): a, c, t, g, unknown or other
  misc_feature (164)..(164): n is a, c, g, or t
  modified_base (313)..(313): a, c, t, g, unknown or other
  misc_feature (313)..(313): n is a, c, g, or t
  modified_base (458)..(473): a, c, t, g, unknown or other
  misc_feature (458)..(473): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgaccccccaaaactcctcattttatcgtaaacaaacaatccggccctcgtcggggtccctgaccgtattcctcccgcctaccaagtctggccacctcacgccctcgctggccatccacgtgggcctccgaggctgaggatggagggtnaattacactgccagtcgtcgaagtagtggttcggcggagggactaagctgaccgtcaggcacgccagctcgcccctggtcactctcgttcccaccctctcactatagtcgtctgacgcgggtctcggacgaagggcgacagtagnnnnnnnnnnnnnnnn

SEQ ID NO: 263950 - DNA, 466 bp, Homo sapiens
  misc_feature: GYAE6OF01EK90V.24.53.E09.1.454.CMB.1.raw
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (455)..(466): a, c, t, g, unknown or other
  misc_feature (455)..(466): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacacgccccccaaaactccctctattttatcgtaacaacaatcggcctctgggtccctgaccgattctccgcctccaagtctgcacctcagcctcgctggccatcacgtggctccaggctggaggatggagggtgattactactgccagtcgtacgaagntggttcggcgggaggtactaagcgtcgaccgtctaggtcacgcccgaagccnccgccctcggtacncgtctcgtccccncctcctcacacttagtacttctagggcgtcgggtctacggcgtaacggcacagtnnnnnnnnnnnn

SEQ ID NO: 263951 - DNA, 630 bp, Homo sapiens
  misc_feature: GYAE6OF01BP4OV.24.53.E09.1.454.CMB.1.raw
  modified_base (320)..(320): a, c, t, g, unknown or other
  misc_feature (320)..(320): n is a, c, g, or t
  modified_base (484)..(484): a, c, t, g, unknown or other
  misc_feature (484)..(484): n is a, c, g, or t
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagcttggggttttccttgttgcttattttagaaggtgtccagtgtgaggtgcaactgggtggagtcgtgggggaggcgttggtccgagccgtcgggggggtccctggagactctcctgtgcagcctctggtacttcccctttagtgtacttttggatgaccgtggggtccnccgaggcctccgaggggacggggctgggaggtgggtggaccaatagaaggcaacggatggacgtagcatgtactatggtgactgtggtggaacgggccgtattccaccatcctccaagacgaaccaacgcccaagaactcactgtatcgtagaactcgacgacnccgtagagtacggtacgacgggaaccgacggtacgttagttacgttaacgttttaacggttacggtacggtacccgaaacctaagttaacgttcccgaaacgtacccgtaacccgttacggggaacgttcccggacgttaaaccgg

SEQ ID NO: 263952 - DNA, 880 bp, Homo sapiens
  misc_feature: GYAE6OF01CFBBD.24.53.E09.1.454.CMB.1.raw
tcagactactatgtcacgaccggtgctcgatttagagagagtgtgttgggtttagggaggcttggtccagccgtggggggtccctgagactctcctgtgcacgcctctggactttcccctttagtgtactttttggatcgaccgtgggtccgccaggcctccgaggggacgggctggagtgggtgaccaatagtaaggcacgatggacgtagcatgtactagtgtggactcgtggtaggaacgggccgtaattccaaccctattccgtacccgaaggaacgaaccgaacccgccccaagaaacctcaaccgttggttaactaccgtaaggaaaattcgaacccgaaggtcccgtaaggaacggtaacggtaccggaacgggaaccctacgggtacttaagtttacgggttaaactttacgtggtcgacccgtaaaccttaattacgtaccgacggcctaaccgggttgggaacgttccgaactacttccgtaaggtaaaccttcccttacgaagggtccgttaaagggttccggggaaccctacggggtacccctacccgttccggtacccgttacccgttccgttacccgtaccgtacccgtaccccgttaacccgaaacccggtaaccggtcccccgttaacggtttcccccggttacccccgttttccccccgggtccgggtcccccgtaccccggttaccggtacccgtaccccgggtaacgggtaccccgtaaccccgtaccccggttacccggaacggtacccgaccgaaccggtaccgggacccgggtcccggtacgggtccgtcgggtacccgtacggtacccgtaacggtacccttaccgtaccgaactacgttacgtcgtcggtaccggg

SEQ ID NO: 263953 - DNA, 298 bp, Homo sapiens
  misc_feature: GYAE6OF01A50X4.24.53.E09.1.454.CMB.1.raw
  modified_base (283)..(298): a, c, t, g, unknown or other
  misc_feature (283)..(298): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttccccgccctcctcacatagtagtctgagcgggctggcaaggcgcatagnnnnnnnnnnnnnnnn

SEQ ID NO: 263954 - DNA, 573 bp, Homo sapiens
  misc_feature: GYAE6OF01C26Z2.24.53.E09.1.454.CMB.1.raw
  modified_base (516)..(516): a, c, t, g, unknown or other
  misc_feature (516)..(516): n is a, c, g, or t
  modified_base (545)..(573): a, c, t, g, unknown or other
  misc_feature (545)..(573): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgaccccccaaaactcctcatttatcgtaaacaacaaatcggccctcgtcggggtccctgaccgattcctccgcctaccaagttctggccacctcacgcctcgctacggccatcgacgtcgggcctccgaggctgaaggatggagggtatacgtttactacgtcgaccaggtccgtacgaaagtagttcggttacggggacgggaggggaactaaggccgtacgtacccggtctaggtccacggtaccccgaacgggtccctcccggccccccgtttcgggtccaccgtttcccgtccgtttcccccgaccccttcctacaactagttacgtacgttcgaggtcggaccgggngtacggacgaacggccgacgtaagtcgannnnnnnnnnnnnnnnnnnnnnnnnnnnn

SEQ ID NO: 263955 - DNA, 338 bp, Homo sapiens
  misc_feature: GYAE6OF01C4A0L.24.53.E09.1.454.CMB.1.raw
  modified_base (293)..(293): a, c, t, g, unknown or other
  misc_feature (293)..(293): n is a, c, g, or t
  modified_base (299)..(338): a, c, t, g, unknown or other
  misc_feature (299)..(338): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtacgaagatggttcggcgggagggactaagctgaccgtcctaggtcacgcccaaggcctcgccccctggtcactctcgttccccgccctcctacactatagtagtcgtggacgcgggcgacggacgaggccanagtagnnnnnnnnnnnnnnnnnnnnnnnnnnnnnnnnnnnnnnnn

SEQ ID NO: 263956 - DNA, 285 bp, Homo sapiens
  misc_feature: GYAE6OF01EC8MG.24.53.E09.1.454.CMB.1.raw
  modified_base (283)..(285): a, c, t, g, unknown or other
  misc_feature (283)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttccccaccctcctcacgatagtagtctgagcgggctggcaaggcgcatagnnn

SEQ ID NO: 263957 - DNA, 304 bp, Homo sapiens
  misc_feature: GYAE6OF01D6ONC.24.53.E09.1.454.CMB.1.raw
  modified_base (287)..(289): a, c, t, g, unknown or other
  misc_feature (287)..(289): n is a, c, g, or t
  modified_base (292)..(304): a, c, t, g, unknown or other
  misc_feature (292)..(304): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgatttactactgccagtcgtacgaagatgttcggcggaggactaagctgaccgtctaggtcagcccaaggcctcgccccctcggtcactctcgttccccaccctcctcacatagtcgtctggagcgggctgggcaaggcgcatagnnnatnnnnnnnnnnnnn

SEQ ID NO: 263958 - DNA, 589 bp, Homo sapiens
  misc_feature: GYAE6OF01EBOU5.24.53.E09.1.454.CMB.1.raw
  modified_base (556)..(556): a, c, t, g, unknown or other
  misc_feature (556)..(556): n is a, c, g, or t
  modified_base (559)..(589): a, c, t, g, unknown or other
  misc_feature (559)..(589): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgaccccccaaactcctcatttatcgtaacaacaatccggccctcgtcggggtccctgaccgtattcctcccgcctaccaagtctcggccacctcacgcctcgcgtcggccatcacgtcgggcctccgaggctaggacggatggagggtgtaattactacgtcgacctaggtcgtacgaagtagttcggttcgggacgggtaggactaagccgtacggaccgttccgtaggtccaccggacccgtaaggccctacccggtccccccgttcggtcctacccgttccgtttaccccgttaccccccctaccccgttaccctactaaccgtaagttacgtacgttccgtaggacgggccgggtcgtacgggaccgtaagggcccgtacaggtacgncgnnnnnnnnnnnnnnnnnnnnnnnnnnnnnnn

SEQ ID NO: 263959 - DNA, 590 bp, Homo sapiens
  misc_feature: GYAE6OF01EUHZL.24.53.E09.1.454.CMB.1.raw
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (510)..(511): a, c, t, g, unknown or other
  misc_feature (510)..(511): n is a, c, g, or t
tcagactactatgtcacgaccggtgctcgatttagagagagtgtgttgagtttgggggctgttttgagctgcttgtaccagagggtcaccatctcctgacaactgggagcaacatcggcgcaggttttgatgtccactggtacaagcagcttacaaaaacngccccaaactcctcatttancgtaacaacaatccggccctcgtggggtccctgaccgtacttcctcccgcctccaagtcctggcacctcagcctcgctgccatcactggctcaggctgagntgaggtnattacctactgaccgaggtcgtacgaagtagtgttcgggcggtaaggactaagcgtcgaccgtccgtagtaccacgacccgaaggcctacggcccccgtcgggtaccacttccgttccgttacccccaccctcctaccaactacgttacgttacgtcttacggacggtcgggtacctgggaacccgaagggtcccgactaacgtacgngacgancngtacnnacgtatgacgtcgcacgtgcgcgtcgtgtcgtcgtagtacgtcgtacgtagtacgtacgtacgtagacgtagtagtacg

SEQ ID NO: 263960 - DNA, 288 bp, Homo sapiens
  misc_feature: GYAE6OF01EOUUL.24.53.E09.1.454.CMB.1.raw
  modified_base (282)..(288): a, c, t, g, unknown or other
  misc_feature (282)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttccccgccctcctcacatagtagtctgagcgggctggcaaggcgcatagnnnnnnn

SEQ ID NO: 263961 - DNA, 462 bp, Homo sapiens
  misc_feature: GYAE6OF01D359H.24.53.E09.1.454.CMB.1.raw
  modified_base (163)..(163): a, c, t, g, unknown or other
  misc_feature (163)..(163): n is a, c, g, or t
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (452)..(462): a, c, t, g, unknown or other
  misc_feature (452)..(462): n is a, c, g, or t
tcagactactatgtcacgaccggtgctcgatttagagagagtgtgttgggtttgggggcggtttttggaagctgcttgtaccagagggtcaccatctcctgcactgggagcaacatcggcgcaggttttgatgtccactggtacaagcagcttaccaaaaacngacccccaaaactcctcattttatcgtaaacaacaagtcggccctcgtcggggtccctgaccgattctccgcctccaagtctggccacctnacgcctcgctgccatcactgggctccaggctgaggatgagggtnattacactgccagtcgtacgaagntggttcgggnggagggactaagctcgaccgtcgtagtcacgcccgaaggcctcgccccctcgtacacttcgtcgtccccgcccctcncactattcgtagtctgaggcgggntcggacaaggccanatagnnnnnnnnnnn

SEQ ID NO: 263962 - DNA, 287 bp, Homo sapiens
  misc_feature: GYAE6OF01BW2QL.24.53.E09.1.454.CMB.1.raw
  modified_base (281)..(287): a, c, t, g, unknown or other
  misc_feature (281)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgcccctcggtcactctcgttcccaccctcctcacatagtagtctgagcgggctggcaaggcgcatagnnnnnnn

SEQ ID NO: 263963 - DNA, 896 bp, Homo sapiens
  misc_feature: GYAE6OF01E2TB9.24.53.E09.1.454.CMB.1.raw
  modified_base (160)..(160): a, c, t, g, unknown or other
  misc_feature (160)..(160): n is a, c, g, or t
  modified_base (809)..(809): a, c, t, g, unknown or other
  misc_feature (809)..(809): n is a, c, g, or t
  modified_base (833)..(833): a, c, t, g, unknown or other
  misc_feature (833)..(833): n is a, c, g, or t
  modified_base (843)..(843): a, c, t, g, unknown or other
  misc_feature (843)..(843): n is a, c, g, or t
  modified_base (869)..(869): a, c, t, g, unknown or other
  misc_feature (869)..(869): n is a, c, g, or t
  modified_base (887)..(888): a, c, t, g, unknown or other
  misc_feature (887)..(888): n is a, c, g, or t
tcagactactatgtcacgaccggtgctcgatttagagagagtgtgttgggttgggggctgttttggagctgcttgtaccagagggtcaccatctcctgcactgggagcaacatcggcgctaggtttgatgtccactggtacaagcagcttaccaaaaacncgacccccaaactcctactatttactaccgtaaacaacaacgtccggccctcgtcggggtccctacgaccgtattccgtcccgcctaccgtaacgtccgtcggacctaccctcgaccggtccctccgccgttcgggaccctacgtccgaccggttcgggcccttaccgacgggtccgttagggaacgggtaagttggggtaacggggttacggtaaactttaacccgttaaccgttcgggtaaccccggtacggttaccgggtaaccggtaaacggtacggtttccggggtttccggggggaccgggtaaacggggtaaacccgttaaagggtccccggtttaaccgggtaaccccggtttcccggttaaacgggtccccggaaaccggtaaccccggtaaaccggggtccccggttaccccgggtacccccccggtttaccggggttacccttaaccccggtttacccgtttacccccggtttaaaccccccaaaccccccgttttcccgtaacccgttaaaccgttaaacgttttaccggggttaaccgttcccggggtaacgggttaaccgggggtcccggggtaccggttaccgggaaccggtaaccggggtacccgaaccgttaaaggtaccgtcgtacggtanacggcgtacgacgtgccgagtttnaaccgttcgngacgagacgcgtgtacgctacgcgtnagcgctactacgtcgacnnctcgtgcg

SEQ ID NO: 263964 - DNA, 281 bp, Homo sapiens
  misc_feature: GYAE6OF01DH0WQ.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttggggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccagctcgcccctcgtcactctcgtcccaccctcctcactatagtagtctgaggcgggctggacaaggcgcatagnnn

SEQ ID NO: 263965 - DNA, 516 bp, Homo sapiens
  misc_feature: GYAE6OF01BWTJ5.24.53.E09.1.454.CMB.1.raw
  modified_base (161)..(161): a, c, t, g, unknown or other
  misc_feature (161)..(161): n is a, c, g, or t
  modified_base (301)..(301): a, c, t, g, unknown or other
  misc_feature (301)..(301): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(489): a, c, t, g, unknown or other
  misc_feature (485)..(489): n is a, c, g, or t
  modified_base (491)..(516): a, c, t, g, unknown or other
  misc_feature (491)..(516): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacagcagcttccaaaaacngcccccaaatcctcatttatcgtaacaacaatccggccctctcggggtccctgaccgattcctcccgcctccaagtctggcacctcagccctcgctggcccatccacgtgggcctccgaggcctaggaggatggagggtnaattactactgcccagtcgtacgaagatggttcgggcggaggactaagcgtcgaccgttctaggtcacgccgaaggtcctccgcccctcggtcacctcttccgtccccgcctccctacactagttacgtagtccgtggacggtccgggcgtacgggacgaacgggccgacgatacgctnntncnnnnngnnnnnnnnnnnnnnnnnnnnnnnnnn

SEQ ID NO: 263966 - DNA, 470 bp, Homo sapiens
  misc_feature: GYAE6OF01EQM3O.24.53.E09.1.454.CMB.1.raw
  modified_base (455)..(456): a, c, t, g, unknown or other
  misc_feature (455)..(456): n is a, c, g, or t
  modified_base (458)..(470): a, c, t, g, unknown or other
  misc_feature (458)..(470): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacagccccccaaaactccctcattttatcgtaaacaacaatccggccctctggggtccctgaccgattctcccgcctccaagtctggcacctcagcctcgctggccatcactgggcctccaggctgaggatgagggtgattactactgccagtcgtcgaagatggttcgggcggagggactaagctgaccgtcctaggtcacgcccaaggctcgccccctcggtcactctcgttccccaccctcctcacatagtacgtctggacgcgggtctgggaccgaaggccgacagtagnngnnnnnnnnnnnnn

SEQ ID NO: 263967 - DNA, 283 bp, Homo sapiens
  misc_feature: GYAE6OF01A4IOI.24.53.E09.1.454.CMB.1.raw
  modified_base (276)..(276): a, c, t, g, unknown or other
  misc_feature (276)..(276): n is a, c, g, or t
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttccccaccctcctcacatagtagtctgagcgggctggcaaggcnaatgnnn

SEQ ID NO: 263968 - DNA, 283 bp, Homo sapiens; identical to SEQ ID NO: 263870
  misc_feature: GYAE6OF01ATUO2.24.53.E09.1.454.CMB.1.raw
  modified_base (281)..(283): a, c, t, g, unknown or other
  misc_feature (281)..(283): n is a, c, g, or t

SEQ ID NO: 263969 - DNA, 505 bp, Homo sapiens
  misc_feature: GYAE6OF01BL0KR.24.53.E09.1.454.CMB.1.raw
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(362): a, c, t, g, unknown or other
  misc_feature (361)..(362): n is a, c, g, or t
  modified_base (368)..(368): a, c, t, g, unknown or other
  misc_feature (368)..(368): n is a, c, g, or t
  modified_base (370)..(371): a, c, t, g, unknown or other
  misc_feature (370)..(371): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (384)..(388): a, c, t, g, unknown or other
  misc_feature (384)..(388): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagactactatgtcacgaccggtgctcgattttagagagagtgtgttagggtttggggggtgtaggggtggtctccacctcccgcccttaggacgggggctgctatctggcctcgctgggcccatcactgggctccagggctgaggatgagggtgattactactgccgagtcgtcgaagatggttcggcggagggactaagctgaccgtcctaggtcacgccccaaggcctcgcccccttggtcacgtctcgttccccgccctcctccactatagtagtctggagcgggctgggacaaggtcgcatagnangacnagacacggtanatcnatcanctnactgtncgancgagcaanananngagagngnngnatntntntntnnnnncncntacagtatagtatactactatntctctactanatctntcgtctctctctactgtacgtacgacgtacgacgtagtacgtacgacgacgacgtcgtacgtacgtacgtctctac

SEQ ID NO: 263970 - DNA, 443 bp, Homo sapiens
  misc_feature: GYAE6OF01E3M06.24.53.E09.1.454.CMB.1.raw
  modified_base (433)..(443): a, c, t, g, unknown or other
  misc_feature (433)..(443): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcattttatcgtaacaacaatcggccctctggggtccctgaccgattctccgcctccaagtctggcacctcagccctcgctggccatcactgggctccaggctgaggatgagggtgattactactgccagtcgtcgaagatggttcggcggaggactaagctgaccgtcctaggtcagcccaaggctcgcccctcggtcactctcgtccccaccctcctcacatagtagtctgagcgggctgggcaaggcgcatagnnnnnnnnnnn

SEQ ID NO: 263971 - DNA, 281 bp, Homo sapiens
  misc_feature: GYAE6OF01EWI7P.24.53.E09.1.454.CMB.1.raw
  modified_base (281)..(281): a, c, t, g, unknown or other
  misc_feature (281)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttcccaccctcctcacatagtagtctgagcgggctggcaaggcgcatagn

SEQ ID NO: 263972 - DNA, 464 bp, Homo sapiens
  misc_feature: GYAE6OF01CUFEV.24.53.E09.1.454.CMB.1.raw
  modified_base (160)..(160): a, c, t, g, unknown or other
  misc_feature (160)..(160): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (415)..(415): a, c, t, g, unknown or other
  misc_feature (415)..(415): n is a, c, g, or t
  modified_base (438)..(464): a, c, t, g, unknown or other
  misc_feature (438)..(464): n is a, c, g, or t
tcagactactatgtcacgaccggtgctcgatttagagagagtgtgttgggtttggggctgttttggagctgcttgtaccagagggtcaccatctcctgcactgggagcaacatcggcgcaggttttgatgtccactggtacaagcagcttaccaaaaacngcccccaaatcctcatttatcgtaacaacaatccggccctctggggtccctgaccgtattcctcccgcctccaagtcctggccacctcagcctcgctggccatcatggctccaggctgagatgagggtnattactacngcctagtcgtcgaagctgttcggcgtagggactaagctcgaccgtctagcagcccaagctcgcccctggcactctcgtccccacctcctcgacacttaagtgtcctggagccgggtntcggccgaaggcgtacaatcgcnnnnnnnnnnnnnnnnnnnnnnnnnnn

SEQ ID NO: 263973 - DNA, 354 bp, Homo sapiens
  misc_feature: GYAE6OF01E4E36.24.53.E09.1.454.CMB.1.raw
  modified_base (300)..(302): a, c, t, g, unknown or other
  misc_feature (300)..(302): n is a, c, g, or t
  modified_base (304)..(309): a, c, t, g, unknown or other
  misc_feature (304)..(309): n is a, c, g, or t
  modified_base (312)..(354): a, c, t, g, unknown or other
  misc_feature (312)..(354): n is a, c, g, or t
tcagactactatgtcacgaccggtgctcgatttagagagagtgtgttggtaggtttggggggtggtggtggtctccactcccgccttggacggggcctgctatctgcctcgctggccatcactgggctccaggctgaggatggagggttgattactactgcctagtcgtcgaagtattagttcggcggagggactaagctgaccgtcctaggtcagcccaagggctcgccccctcggtccaccgtctcgttccccaccctcctcacatagtagtctgagcggctggcaaggcgcatacgnnntnnnnnncgnnnnnnnnnnnnnnnnnnnnnnnnnnnnnnnnnnnnnnnnnnn

SEQ ID NO: 263974 - DNA, 287 bp, Homo sapiens
  misc_feature: GYAE6OF01CS9VR.24.53.E09.1.454.CMB.1.raw
  modified_base (282)..(287): a, c, t, g, unknown or other
  misc_feature (282)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctcacatagtagtctgagcgggctggcaaggcgcatagnnnnnn

SEQ ID NO: 263975 - DNA, 518 bp, Homo sapiens
  misc_feature: GYAE6OF01DCCFK.24.53.E09.1.454.CMB.1.raw
  modified_base (252)..(252): a, c, t, g, unknown or other
  misc_feature (252)..(252): n is a, c, g, or t
  modified_base (494)..(518): a, c, t, g, unknown or other
  misc_feature (494)..(518): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagaagcttaccaaaaaacagccccccaaaactcctcatttatcgtaaacaacaatcggccctcgtggggtccctgaccgattctcccgcctccaagtctggcacctnagcctcgctggccatcacgtgggcctccgaggctgaggatggagggtgattactacgtcgccaggtcgtacgaagtatggttcgggcgggaagggactaaagctacggacccgtccgtagggtcacgcccaaggtcctcgcccccgtcggtcctacctccttccgttccccaccctccgtcaacctattacgtacgttcgtggacgggcgggtcgtacggacgaacgggtcgacagtacgcnnnnnnnnnnnnnnnnnnnnnnnnn

SEQ ID NO: 263976 - DNA, 293 bp, Homo sapiens
  misc_feature: GYAE6OF01CEYQ4.24.53.E09.1.454.CMB.1.raw
  modified_base (287)..(293): a, c, t, g, unknown or other
  misc_feature (287)..(293): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttccccgccctcctcacatagtagtctgaggccgggctgggcaaaggcgacatagnnnnnnn

SEQ ID NO: 263977 - DNA, 521 bp, Homo sapiens
  misc_feature: GYAE6OF01CRKQ8.24.53.E09.1.454.CMB.1.raw
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccagggacgggctggagtgggtgccaaatataaggcacgatggacgtagcatgtactatgtcggactctgtgaagggccattcaccatcaccagagacaacgcccagaactcactgtaatctaggaaatgaccagcctganagtcgaggacacggctatgtatactgngacgaccanatcagcactggagtcgcatctgaaatcttccagcagttgggccagggcacccgtggtcaccgtctcctcacgcctccaaccgaagggcccagtcggccttcccccnggccgcctgctccgacggagccacccncgagacgcacacgcgccgtggctcgctgtcaaggacctactccanatagtagtntacgg

SEQ ID NO: 263978 - DNA, 291 bp, Homo sapiens
  misc_feature: GYAE6OF01CKY7S.24.53.E09.1.454.CMB.1.raw
  modified_base (283)..(283): a, c, t, g, unknown or other
  misc_feature (283)..(283): n is a, c, g, or t
  modified_base (288)..(291): a, c, t, g, unknown or other
  misc_feature (288)..(291): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttcccaccctcctcactatagtagtctggacgcggggctggccaagggccncatgnnnn

SEQ ID NO: 263979 - DNA, 283 bp, Homo sapiens
  misc_feature: GYAE6OF01BPGK1.24.53.E09.1.454.CMB.1.raw
  modified_base (283)..(283): a, c, t, g, unknown or other
  misc_feature (283)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacattagtagtctgagcgggctggcaaggcgcatagn

SEQ ID NO: 263980 - DNA, 690 bp, Homo sapiens
  misc_feature: GYAE6OF01A8FFM.24.53.E09.1.454.CMB.1.raw
tcagactactatgtcacgaccggtgctcgatttagagagagtgtgttgggtttgggaggcttggtccagcctggggggtccctgagactctcctgtgcagcctctggacttcccctttagtgactttttggatgacctgggtccgccaggctccgagggacgggctggagtgggtggccaatataaggcacgatggacgtagcatgtactatgtggactctgtggaacgggccattccaccatcctccagacgacaacgcccagaactcactgtatcgtaggaaatgaccagcctagagagtcgaggacacggctatgtattactgtcgacgacctatactcacgcaccgtgggacgtcgactacttctaagtaaacttaccttccgaagtcgtagggttcggggacccaacggggccctacccgtcggtacccgtacccgtcctccctccgaccgtcccgtacccgaaccgaaccgggtcccctaaccgttcccggttaccccgtttcccccgtccggtccccgtccccgtccgtccgtacccgacggaccgacccgtacccgtccggaacgacgaccgaaccggaccggcccggtcccggtcgggtaccgtccggtacccggttacgggtaccgtaaccggtacccttaacccgtacccgtaacgtagttaacgtcggttcgtacggg

SEQ ID NO: 263981 - DNA, 600 bp, Homo sapiens
  misc_feature: GYAE6OF01C46P7.24.53.E09.1.454.CMB.1.raw
  modified_base (240)..(240): a, c, t, g, unknown or other
  misc_feature (240)..(240): n is a, c, g, or t
  modified_base (563)..(563): a, c, t, g, unknown or other
  misc_feature (563)..(563): n is a, c, g, or t
  modified_base (569)..(600): a, c, t, g, unknown or other
  misc_feature (569)..(600): n is a, c, g, or t
tcagactactatgtcacgaccggtgctcgatttagagagagtgtgttgggtttgggggctgttttggaagctgcttgtaccagagggtcaccatctcctgcactgggagcaaacatcggcgcaggttttgatgtccactggtacaagcagccttaccaaaaacacgaccccccaaaactcctactattttaatcgtaaacaacaactccgggcccttcgtcggggtccctagaacccgtnttcctcccgccctacaaagtctcggcacctcacgcctcgctggccatccagtcggctaccgaggctggaaggagttggagggtgtaacttactagttcgccgtaggtcgtaccgaaggtagttcggtacggggcggtaacggggaactaaacggctacgtacccgtacgttaacggtccgaacgaccccgaaaggcccgtaccggtcccccctgggtcctaccgttctcccgtttccccgacccttccctacgacctagttacgtacgttcgcggtacggcccgggtcgtcgggacgaaccggacgttaccgtaaagtccggntagcgnnnnnnnnnnnnnnnnnnnnnnnnnnnnnnnn

SEQ ID NO: 263982 - DNA, 291 bp, Homo sapiens
  misc_feature: GYAE6OF01BKDMM.24.53.E09.1.454.CMB.1.raw
  modified_base (283)..(291): a, c, t, g, unknown or other
  misc_feature (283)..(291): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctcacatagtagtctggagcgggctggcaaggcgcatagcnnnnnnnnn

SEQ ID NO: 263983 - DNA, 404 bp, Homo sapiens
  misc_feature: GYAE6OF01DAHYI.24.53.E09.1.454.CMB.1.raw
  modified_base (241)..(241): a, c, t, g, unknown or other
  misc_feature (241)..(241): n is a, c, g, or t
  modified_base (352)..(352): a, c, t, g, unknown or other
  misc_feature (352)..(352): n is a, c, g, or t
  modified_base (392)..(404): a, c, t, g, unknown or other
  misc_feature (392)..(404): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggcccatcacgtgggcctccaggctggaggatggagggtnattactactgccaggtcgtacgaagatgttcggcggagggactaagctgaccgtcctaggtccagcccgaaggcctcgcccccgtggccactctcgttccccacccctccncacactagtatctgacgcgggctggcaaggccgcagtagnnnnnnnnnnnnn

SEQ ID NO: 263984 - DNA, 283 bp, Homo sapiens
  misc_feature: GYAE6OF01D91XB.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggccaaggcgcatagnnnn

SEQ ID NO: 263985 - DNA, 299 bp, Homo sapiens
  misc_feature: GYAE6OF01B0BWF.24.53.E09.1.454.CMB.1.raw
  modified_base (290)..(299): a, c, t, g, unknown or other
  misc_feature (290)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggaggactaagctgaccgtcctaggtcagcccaaggctcgccccctggtcactctcgttccccaccctcctcacatagtagtctggacggcgggctggcgaagggccgtcatagnnnnnnnnnn

SEQ ID NO: 263986 - DNA, 281 bp, Homo sapiens
  misc_feature: GYAE6OF01B68G9.24.53.E09.1.454.CMB.1.raw
  modified_base (278)..(281): a, c, t, g, unknown or other
  misc_feature (278)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagccaagctcgccccctggtcactctcgttcccgccctcctcacatagtagtctgagcgggctggcaaggcgcatagnnnn

SEQ ID NO: 263987 - DNA, 460 bp, Homo sapiens
  misc_feature: GYAE6OF01CTUKH.24.53.E09.1.454.CMB.1.raw
  modified_base (164)..(164): a, c, t, g, unknown or other
  misc_feature (164)..(164): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (445)..(460): a, c, t, g, unknown or other
  misc_feature (445)..(460): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtcccactggtacaagcagcttccaaaaacngccccccaaactcctcattttatcgtaacaacaatcggccctctggggtccctgaccgattctccgcctccaagtctggcacctcagcctcgctggccatcactgggctcaggctgaggatggaggtnattactactgccagtcgtcgaagntcggtcgggcggagggactaaggctcgaccgtctaggtcacgcccaaggcctcgccccctggtccactctcgtcccaccctctcacatacgtacgtctgacggcgggctcgggacaacggcgacatagnnnnnnnnnnnnnnnn

SEQ ID NO: 263988 - DNA, 283 bp, Homo sapiens
  misc_feature: GYAE6OF01BCZL5.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttccccgccctcctcacatagtagtctgagcgggctggcaaggcgcatagnnn

SEQ ID NO: 263989 - DNA, 475 bp, Homo sapiens
  misc_feature: GYAE6OF01B5T23.24.53.E09.1.454.CMB.1.raw
  modified_base (163)..(163): a, c, t, g, unknown or other
  misc_feature (163)..(163): n is a, c, g, or t
  modified_base (316)..(316): a, c, t, g, unknown or other
  misc_feature (316)..(316): n is a, c, g, or t
  modified_base (444)..(450): a, c, t, g, unknown or other
  misc_feature (444)..(450): n is a, c, g, or t
  modified_base (452)..(475): a, c, t, g, unknown or other
  misc_feature (452)..(475): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaatcctcatttatcgtaacaacaatcggccctcgtggggtccctgaccgattcctccgcctccaagtctggccacctcagcctcgctggccatcatcgggctccaggctgaggatgaggtgattactactgccagtcgtagaagntggtcggcggaggactaagctacggaccgtcctaggtccagccccgaaggcctcgccccctggccactctcgttccccaccctctcactagtagtacgtctagcgcgggtctggacaaggcacatagnnnnnnngnnnnnnnnnnnnnnnnnnnnnnnn

SEQ ID NO: 263990 - DNA, 579 bp, Homo sapiens
  misc_feature: GYAE6OF01C5KEY.24.53.E09.1.454.CMB.1.raw
  modified_base (165)..(165): a, c, t, g, unknown or other
  misc_feature (165)..(165): n is a, c, g, or t
  modified_base (246)..(246): a, c, t, g, unknown or other
  misc_feature (246)..(246): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (546)..(579): a, c, t, g, unknown or other
  misc_feature (546)..(579): n is a, c, g, or t
tcagactactatgtcacgaccggtgctcgatttagagagagtgtgttgggtttgggggctgttttggagctgcttgtaccagagggtcaccatctcctgcactgggagcaacatcggcgctaggttttgatgtccactggtacaagcagaccttaccaaaaaacncgacccccaaaactccctctaatttactacgtaaacaaacaacgtccggcccctcgtcggggtcccctgacccgtattccncccgtccctacccaaggttcctggaccctaacctcgaacgtccctcggactggccatccacgtggcctccgaggctggacgatggaggtgtattacactcgaccagttccgtacggaaagtgttacggttcggggacggtagggaaccttaagccgtcgtaccggtccttaggccacggtccccgaaggtccctccggccccctggacctaccttccgtccgttcccccaaccttccgtacactaagtcgttacgccgtaaggcggccgggtgtcggaacgtagacccggntaancgagnnnnnnnnnnnnnnnnnnnnnnnnnnnnnnnnnn

SEQ ID NO: 263991 - DNA, 514 bp, Homo sapiens
  misc_feature: GYAE6OF01C3QI9.24.53.E09.1.454.CMB.1.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
  modified_base (493)..(514): a, c, t, g, unknown or other
  misc_feature (493)..(514): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaatcctcatttatcgtaacaacaatcggccctctcggggtcccctgaccgattcctcccgcctccaagtctggccacctcagcctcgctggccatccactgggcctccagggctggaggatggagggtnaacttactacgtgacccagttcgtcgaagtagttggttccgggnggagggactaaggctcgtaccgtcctaggtccacgcccgaaggccctccgcccccgttggccaccgttcctcgttacccccncccttccttacaacgtatacgtacgtcgtaggacggcgggcgtcggacgtaacgggcgacagtagcnnnnnnnnnnnnnnnnnnnnnn

SEQ ID NO: 263992 - DNA, 513 bp, Homo sapiens
  misc_feature: GYAE6OF01B2IMC.24.53.E09.1.454.CMB.1.raw
  modified_base (162)..(162): a, c, t, g, unknown or other
  misc_feature (162)..(162): n is a, c, g, or t
  modified_base (478)..(485): a, c, t, g, unknown or other
  misc_feature (478)..(485): n is a, c, g, or t
  modified_base (487)..(498): a, c, t, g, unknown or other
  misc_feature (487)..(498): n is a, c, g, or t
  modified_base (500)..(513): a, c, t, g, unknown or other
  misc_feature (500)..(513): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaatcctcatttatcgtaacaacaatcggccctcgtggggtcccctggaccgattcctccgcctccgaagtcctggcacctcagccctcgctggccatcactgggctccaggctggaggatggagggtgattactactgccaggtccgtacggaagagtggttcgggcgggaagggactaagctaggacccgtccgtaaggtccagtcccaaggcctcgccccctggtcactcgtcgtccccaccctcctcacatagtcgtctggagtccggggctcgggaccgaagggtccgactacgtaaggcagnnnnnnnngnnnnnnnnnnnngnnnnnnnnnnnnnn

SEQ ID NO: 263993 - DNA, 992 bp, Homo sapiens
  misc_feature: GYAE6OF01DHE4G.24.53.E09.1.454.CMB.1.raw
  modified_base (495)..(495): a, c, t, g, unknown or other
  misc_feature (495)..(495): n is a, c, g, or t
tcagactactatgtcacgaccggtgctcgatttagagagagtgtggttggggtttgggggaggacttggtccagccgttgggggggtcccctaggaacggaacctctccgtaggtccgacgacgccctcgtcggtacctttccccctttttaggtcgtaacgttttttgggacttcggacccggttcggggtccccgaccgaacgggtccctaccggaaggggggaaccgggggtacttagggggtagggttgggggttaccggaaccctaaagtaacgttaaacgggccaacggacttcgggaacggttagctagttcggttaaccgtaaggtacggtacgggacccttccgttggtacggaacggggccgtaacgttccaacctactccgtaccgaaggaacgaaccgtaaccggacccaaggtaacctctacgttagtaataccgaaggaaactcgaaccacgcctaggagcgtccggaagtacctacggtntagttcgtaacttaccgcggtacgacggacctatacgtaccacgacctacggtggacgtcgactaacgttcgtaaggtaaccttaccggtaccgtaacggtccgttacgggttaccggggacccgaccggggtaacccttacccgggttacggtaaccccgtacccggttccctaccccgtacgaccccgttaccgttaacccggaaacccggtaaccgggttaccccttacgggtttacccccggttttaccccgtttacccccgggtcgggtaccccgtcccccgttaggaccccttaaccggtaacgggtaaccctaccccggtacccgttacccggtaaacgtacccgggtaccgtaaccggaacccgggtacccgggtacccgggttacgggaccggttaaaccgggaccccgggttaaggtaaacccggtaaaccgggttaccttaaccgtaccgtaaaccttaggttaccgttacgggtcggtaaccggg

SEQ ID NO: 263994 - DNA, 525 bp, Homo sapiens
  misc_feature: GYAE6OF01BBM8I.24.53.E09.1.454.CMB.1.raw
  modified_base (164)..(164): a, c, t, g, unknown or other
  misc_feature (164)..(164): n is a, c, g, or t
  modified_base (306)..(306): a, c, t, g, unknown or other
  misc_feature (306)..(306): n is a, c, g, or t
  modified_base (506)..(525): a, c, t, g, unknown or other
  misc_feature (506)..(525): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgaccccccaaactcctcatttatcgtaaacaacaatccggccctcgtcggggtccctgacccgtattcctccgcctaccaagtctggcacctcacgccctcgctggccatcacgtggcctccaggctgaggatggagggtntacttactactcgccagttccggtacgaagattggtacgggacggagggactaaggctacggaccgtccaggtcacggtcccaagggtcctccggcccccgtcggtccacgttccgttccgtcccccaccccttcctccaactacgttacgttacgtcgtggacggtccgggtcgtgggacgtaagggccgacgtatagnnnnnnnnnnnnnnnnnnnn

SEQ ID NO: 263995 - DNA, 287 bp, Homo sapiens
  misc_feature: GYAE6OF01B3ANK.24.53.E09.1.454.CMB.1.raw
  modified_base (282)..(287): a, c, t, g, unknown or other
  misc_feature (282)..(287): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctacactatagtagtctgagcgggctggcaaggcgcatagnnnnnn

SEQ ID NO: 263996 - DNA, 578 bp, Homo sapiens
  misc_feature: GYAE6OF01DLPS3.24.53.E09.1.454.CMB.1.raw
  modified_base (546)..(578): a, c, t, g, unknown or other
  misc_feature (546)..(578): n is a, c, g, or t
tcagactactatgtcacgaccggtgctcgatttagagagagtgtgttggggtttgggggctgtttttggaagctgcttgtaccagagggtcaccatctcctgcactgggagcaacatcggcgcaggttttgatgtccactggtacaagcagcttaccaaaaacacgaccccccaaactcctcatttatacgtaaacaacaatccggcccttcgtcggggtccctgaccgtattcctcccgcctccaagtctggccacctcacgccctcgcgtggccatccacgtgggcctccgaggctggaaggatagggagggtgtaactttacctacgtcgccgtaggtcggtacgaaagtgttcgggttccgggacgggaagggaccttaagcgtcgaccgttccgtagggtccacgccccgtaaggccctccggtaccccccgttgggtccctacgttcccgttcccgttaccccctacccttccctaccactaacgttagttacgtctggtacggccgggtctacgggacgaacggtcgaccagtagatcnnnnnnnnnnnnnnnnnnnnnnnnnnnnnnnnn

SEQ ID NO: 263997 - DNA, 447 bp, Homo sapiens
  misc_feature: GYAE6OF01A9Z7C.24.53.E09.1.454.CMB.1.raw
  modified_base (162)..(162): a, c, t, g, unknown or other
  misc_feature (162)..(162): n is a, c, g, or t
  modified_base (280)..(280): a, c, t, g, unknown or other
  misc_feature (280)..(280): n is a, c, g, or t
  modified_base (392)..(392): a, c, t, g, unknown or other
  misc_feature (392)..(392): n is a, c, g, or t
  modified_base (432)..(447): a, c, t, g, unknown or other
  misc_feature (432)..(447): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactggctccaggctgaggntgagggtgattactactgccagtcgtcgaagatgttcggcggagggactaagctgaccgtctaggtcagcccaaggctcgccccctggtccactctcgttccccgccctccncacatagtagtctgagcgggctgggcaaggccgcagtagnnnnnnnnnnnnnnnn

SEQ ID NO: 263998 - DNA, 555 bp, Homo sapiens
  misc_feature: GYAE6OF01DFQ3Q.24.53.E09.1.454.CMB.1.raw
  modified_base (163)..(163): a, c, t, g, unknown or other
  misc_feature (163)..(163): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (532)..(555): a, c, t, g, unknown or other
  misc_feature (532)..(555): n is a, c, g, or t
tcagactactatgtcacgaccggtgctcgatttagagagagtgtgttgggtttgggggctgtttttggaagctgcttgtaccagagggtcaccatttcctgcactgggagcaacatcggcgcaggttttgatgtccactggtacaagcagcttaccaaaaacncgcccccaaaactcctacattttatccgtaaacaacaatccggcccttcgtggggtcccctggaccgattcctcccgcctccaagtcctggccacctcagcctcgctcggccatcacgtgggcctccaggctggaggatggagggtnattactacgngccgaggtccgtacggaaagtcgtcggttaccgggngggaacgggtactaaagcctacggacccgttccgtaggtccacggaccccgtaagggccttcccgaccccccgtggtacctaccgtccgttccgttccccccgacccttcctaccacagtttacgtacgtccgtggacgggccggtcgtgggacgtacgggcctcgaacgtgctgnnnnnnnnnnnnnnnnnnnnnnnn

SEQ ID NO: 263999 - DNA, 634 bp, Homo sapiens
  misc_feature: GYAE6OF01CJRNW.24.53.E09.1.454.CMB.1.raw
  modified_base (596)..(596): a, c, t, g, unknown or other
  misc_feature (596)..(596): n is a, c, g, or t
  modified_base (601)..(602): a, c, t, g, unknown or other
  misc_feature (601)..(602): n is a, c, g, or t
  modified_base (604)..(634): a, c, t, g, unknown or other
  misc_feature (604)..(634): n is a, c, g, or t
tcagactactatgtcacgaccggtgctcgatttagagagagtgtgttgggtttgggggctgttttggaagctgcttgtaccagagggtcaccatctcctgcactgggagcaacatcggcgctaggttttgatgtccatggtacaagcagtccttaaccaaaaaacgccaccccccaaaactcctatatttactaccgtaaacaaactaacgtccggccctcggtcggggtcccctgaccgtattcctcccgcctaccaaggtcctcggcctaacctcacgcctcgcgtacgccatccgacgtcggcctaccgaggcctaggaggtagtggaggggttactaagttaccttaacgcgtacccgtaaggttccggtaagaaacggtgttcgggtaccggggaacgggtaaagggtaacctaacgggtccgtaaccggtaaccccggttaccgaagggtacccgaaacggccccgtaaacggtccccgtacccggtcccccgtaggtccctacgttcccgtttacccgtccccgtccccttacgactaacgtagttaacgtccgagtcgggacggtcgggtcgaggaccgaaggccaanagtcnncnnnnnnnnnnnnnnnnnnnnnnnnnnnnnnn

SEQ ID NO: 264000 - DNA, 285 bp, Homo sapiens; identical to SEQ ID NO: 263615
  misc_feature: GYAE6OF01BDXJ1.24.53.E09.1.454.CMB.1.raw
  modified_base (280)..(285): a, c, t, g, unknown or other
  misc_feature (280)..(285): n is a, c, g, or t

SEQ ID NO: 264001 - DNA, 307 bp, Homo sapiens
  misc_feature: GYAE6OF01A95AX.24.53.E09.1.454.CMB.1.raw
  modified_base (294)..(307): a, c, t, g, unknown or other
  misc_feature (294)..(307): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcaactatagtagtcgtgacggcgggtcgtggacgaacggcgtacagtagcnnnnnnnnnnnnnn

SEQ ID NO: 264002 - DNA, 287 bp, Homo sapiens
  misc_feature: GYAE6OF01AJTCU.24.53.E09.1.454.CMB.1.raw
  modified_base (283)..(287): a, c, t, g, unknown or other
  misc_feature (283)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagnnnnn

SEQ ID NO: 264003 - DNA, 502 bp, Homo sapiens
  misc_feature: GYAE6OF01ETP45.24.53.E09.1.454.CMB.1.raw
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (471)..(487): a, c, t, g, unknown or other
  misc_feature (471)..(487): n is a, c, g, or t
  modified_base (489)..(502): a, c, t, g, unknown or other
  misc_feature (489)..(502): n is a, c, g, or t
tcagactactatgtcacgaccggtgctcgatttagagagagtgtgttgagtttgggggctgttttggaagctgcttgtaccagagggtcaccatctcctgcactgggagcaacatcggcgcaggttttgatgtccactggtacaagcagcttccaaaaacngcccccaaatcctcatttancgtaacaacaatcggccctcgtggggtccctgaccgattccnccgcctcaagtctggccacctcagcctgctggccatcactgggctccaggctgaggatggagggtgattactactgccaggtcgngaagtagtggtcgggcggagggactaagctgaccgtctaggcagcccgagcctcgccccctggtcactccgtcgttccccgcccttccgtacactagtacggttacgtcgtggacgggtccggggcctagggaccgaaagggccgactaagtacggntgnacnnnnnnnnnnnnnnnnngnnnnnnnnnnnnnn

SEQ ID NO: 264004 - DNA, 1047 bp, Homo sapiens
  misc_feature: GYAE6OF01EUMZ3.24.53.E09.1.454.CMB.1.raw
  modified_base (268)..(268): a, c, t, g, unknown or other
  misc_feature (268)..(268): n is a, c, g, or t
tcagactactatgtcacgaccggtgctcgatttagagagagtgtgttgggtttgggaggcttggtccagccgtggggggtccctgagactctcctgtgcagcctctggacttcccctttagtgtacttttggatgaccgtgggtccgccaggcctccgaggggacgggctgggaggtgggtcggaccaatagtaaggcacggatgggacgtagcatgtactatggtggactgtggtagaacgggcctattccaccatcctacaagganaaccaaccgccaagaacctcacttgtatcgaggaaactcgaccagtcctaggaacgtacggtacggaaggtaccgacgggtacttaagttaggttaacttttaccggtggttacggacccggtaaacccttaatttaaccgtacgaacgggtaccccctaacgggttacggggaaccggttcccgaacttaccggttaacctttaaacggtaaaccttttaccccttaccggaacgttccggtaaacggggttttccccggggggaccggttaaaaccccggggccctttaacccccggttacggggggttacccccttaacccccggggtttacccctaccccgtttaacccggaaccccggtttacccccgtaacccccggtaaaccccgggtaaacccccggggtacccccgtttaaccgggtttacccccccgggtttccccccgttttaacccccccggggtcggggtaccccccccgttcccccggttacccgggtaccccggttaccccgggtaacggggtaaccccggttacccccgtaaccccccggttacccggggaaaccggtacccggaaacccccggtaccgaaccccggggggttacccccgggtcccccgggttaaccgggggtcccgtttcccggggtcccccgggttaaacccggggttaaacccgggtaaaccggttaacccccggttaaccccgtttaacccggtaaccgttaaacccgggttttacgggttaaacccgggttttggaaaccccgggggg

SEQ ID NO: 264005 - DNA, 640 bp, Homo sapiens
  misc_feature: GYAE6OF01CL7R4.24.53.E09.1.454.CMB.1.raw
  modified_base (162)..(162): a, c, t, g, unknown or other
  misc_feature (162)..(162): n is a, c, g, or t
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (612)..(640): a, c, t, g, unknown or other
  misc_feature (612)..(640): n is a, c, g, or t
tcagactactatgtcacgaccggtgctcgatttagagagagtgtgttgggtttgggggctgttttggaagctgcttgtaccagagggtcaccatctcctgcactgggagcaaacatcggcgctaggttttgatgtccactggtacaagcagctacaaaaacncgaccccaaatcctnatttatacgtaaacaacaagtccggccctcgtcggggtccctgaaccgtattccnccgcctaccaagtctggcctacctcacgtcctcgccgtcggaccctatccacgtcgggacctccgaggctaggaggagtgggagggttacaacttaactacgtcgacccgtaagttccgtaagaaagtacgtcgggtcgggacggaagggtaactaacggccttacggacccggttaccttaagggaccaaaccggaccccgaaaggggtcccttacccgggccccccgttagggtcccttaaccgttcccgtttaccccggttccccccccaaacccgttccctaacgtaaacccgttaacgttaaagggtttccggtacgttacgggaacggggtccgggtacggtacgggaaccggtaacgggactaacgtaagagnnnnnnnnnnnnnnnnnnnnnnnnnnnnn

SEQ ID NO: 264006 - DNA, 285 bp, Homo sapiens
  misc_feature: GYAE6OF01BCCYV.24.53.E09.1.454.CMB.1.raw
  modified_base (281)..(285): a, c, t, g, unknown or other
  misc_feature (281)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccgccctcctcacatagtagtctgagcgggctggcaaggcgcatagnnnnn

SEQ ID NO: 264007 - DNA, 308 bp, Homo sapiens
  misc_feature: GYAE6OF01EGD46.24.53.E09.1.454.CMB.1.raw
  modified_base (291)..(308): a, c, t, g, unknown or other
  misc_feature (291)..(308): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggaggactaagctgaccgtctaggtcacgaccaggctcgcccctcggtcactctcgttccccgccctcctacactatagtagtcgtgaggcgggtctaggcgaacggcgctaatgannnnnnnnnnnnnnnnnn

SEQ ID NO: 264008 - DNA, 290 bp, Homo sapiens
  misc_feature: GYAE6OF01DZC4S.24.53.E09.1.454.CMB.1.raw
  modified_base (283)..(290): a, c, t, g, unknown or other
  misc_feature (283)..(290): n is a, c, g, or t
tcagactactatgtcacgaccggtgctcgatttagagagagtgtgttggggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgcccctcggtcactctcgttcccaccctctcacatagtagtctgagcggggctggacaaggcgcatagnnnnnnnn

SEQ ID NO: 264009 - DNA, 488 bp, Homo sapiens
  misc_feature: GYAE6OF01BI1YG.24.53.E09.1.454.CMB.1.raw
  modified_base (323)..(323): a, c, t, g, unknown or other
  misc_feature (323)..(323): n is a, c, g, or t
  modified_base (459)..(459): a, c, t, g, unknown or other
  misc_feature (459)..(459): n is a, c, g, or t
  modified_base (461)..(488): a, c, t, g, unknown or other
  misc_feature (461)..(488): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagcttaccaaaaacacgaccccccaaactcctctatttatcgtaacaacaatcggccctcgtcggggtccctgaccgattcctccgcctccaagtctggcacctcagcctcgctggcctatcacgtgggctccaggctgaggatggagggtgattactactgccagtcgtcgaagntggttcggcggagggactaagctgaccgtctaggtcacgacccaaggctcgcccccgtggtccactctcgtccccgcccctcctcacatacgtactcgtgacggtccgggcgtggaccgaacgggcgacgagtcgngnnnnnnnnnnnnnnnnnnnnnnnnnnnn

SEQ ID NO: 264010 - DNA, 473 bp, Homo sapiens
  misc_feature: GYAE6OF01AX5IS.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
  modified_base (450)..(473): a, c, t, g, unknown or other
  misc_feature (450)..(473): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacngcccccaaatcctcatttancgtaacaacaatccggccctctggggtccctgaccgattctccgcctccaagtctggcacctcagcctcgctggccatcactggctcagctgagntgaggtnattactacngccagtcgtcgaagatggtcggcggaggactaagctgaccgtcgtaggtcacgccgaaggcctccgcccccgtggtctacctcgtcgttcccccgccctcctacacagtacggtntcgtgacggtccgggtactcgggactaaggccgactanacgnnnnnnnnnnnnnnnnnnnnnnnn

SEQ ID NO: 264011 - DNA, 300 bp, Homo sapiens
  misc_feature: GYAE6OF01CCDK0.24.53.E09.1.454.CMB.1.raw
  modified_base (287)..(300): a, c, t, g, unknown or other
  misc_feature (287)..(300): n is a, c, g, or t
tcagactactatgtcacgaccggtgctcgatttagagagagtgtgttgggtttggggggtgtggtggtctccactcccgccttggacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttccccaccctcctcacatagtagtctggagccgggactgggcaaggcgcatagnnnnnnnnnnnnnn

SEQ ID NO: 264012 - DNA, 308 bp, Homo sapiens
  misc_feature: GYAE6OF01B2GYX.24.53.E09.1.454.CMB.1.raw
  modified_base (273)..(273): a, c, t, g, unknown or other
  misc_feature (273)..(273): n is a, c, g, or t
  modified_base (293)..(308): a, c, t, g, unknown or other
  misc_feature (293)..(308): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcacgcccaaggcctcgccccctggtcactctcgttcccaccctcctacactataggtagtctggacgcgggtcngggacaagggcgctaatgannnnnnnnnnnnnnnn

SEQ ID NO: 264013 - DNA, 491 bp, Homo sapiens
  misc_feature: GYAE6OF01BUM5F.24.53.E09.1.454.CMB.1.raw
  modified_base (160)..(160): a, c, t, g, unknown or other
  misc_feature (160)..(160): n is a, c, g, or t
  modified_base (457)..(458): a, c, t, g, unknown or other
  misc_feature (457)..(458): n is a, c, g, or t
  modified_base (460)..(470): a, c, t, g, unknown or other
  misc_feature (460)..(470): n is a, c, g, or t
  modified_base (475)..(491): a, c, t, g, unknown or other
  misc_feature (475)..(491): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttccaaaaacngcccccaaaactcctcatttatcgtaaacaacaatccggccctctggggtccctgaccgattctccgcctccaagttctggcacctcagccctgactggcccatcactgggctccagctgaggatggagggtgattactactcgccagtcgtcgaagatggtcggcggaggactaagctgaccgtctaggtcagcccaaggctcgcccccgtggtccacgtcctcgttccccacccctcctcacatgtacgtctggacggccgggacgtcgggacgtaacgggccgctaagtacggnngnnnnnnnnnnnttttnnnnnnnnnnnnnnnnn

SEQ ID NO: 264014 - DNA, 280 bp, Homo sapiens
  misc_feature: GYAE6OF01ATHK2.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnn

SEQ ID NO: 264015 - DNA, 449 bp, Homo sapiens
  misc_feature: GYAE6OF01EJJDQ.24.53.E09.1.454.CMB.1.raw
  modified_base (183)..(183): a, c, t, g, unknown or other
  misc_feature (183)..(183): n is a, c, g, or t
  modified_base (286)..(286): a, c, t, g, unknown or other
  misc_feature (286)..(286): n is a, c, g, or t
  modified_base (387)..(387): a, c, t, g, unknown or other
  misc_feature (387)..(387): n is a, c, g, or t
  modified_base (418)..(418): a, c, t, g, unknown or other
  misc_feature (418)..(418): n is a, c, g, or t
  modified_base (439)..(449): a, c, t, g, unknown or other
  misc_feature (439)..(449): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaacagcccccaaactcctcatttancgtaacaacaatcggcctctggggtccctgaccgattctccgcctccaagtctggcacctcagcctcgctggccatcactggctcaggctgaggatgagggtnattactactgccagtcgtcgaagatgttcggcggaggactagctcgaccgtcctaggcacgcccaaggctcgccccctcggtcactcctcgtccccgtccnccctcacatagtatcgtgtacgccggggtcncgggcacggtcgccgtatggnnnnnnnnnnn

SEQ ID NO: 264016 - DNA, 291 bp, Homo sapiens
  misc_feature: GYAE6OF01BC0IM.24.53.E09.1.454.CMB.1.raw
  modified_base (287)..(291): a, c, t, g, unknown or other
  misc_feature (287)..(291): n is a, c, g, or t
tcagactactatgtcacgaccggtgctcgatttagagagagtgtgttgagtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggcctcgccccctcggtcactctcgttccccaccctcctcacatagtagtctgacgcgggctggcaaggcgcaatagnnnnn

SEQ ID NO: 264017 - DNA, 461 bp, Homo sapiens
  misc_feature: GYAE6OF01DX7G2.24.53.E09.1.454.CMB.1.raw
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (451)..(461): a, c, t, g, unknown or other
  misc_feature (451)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagacccccaaactccctcatttatcgtaaacaacaatcggccctcgtggggtccctgaccgattctccgcctccaagtctggccacctcagcctcgctggccatcactgggctccaggctgaggatgagggtgattactactgcagtcgtcgaagtagtggttcggcggaggaactagctgaccgtctaggtcagcccgaaggctcgcccccgtggtccacctctccgttccccacccctctcacattagtatcgtggacgcgggntcggacgtaaggccgnatagnannnnnnnnnnn

SEQ ID NO: 264018 - DNA, 559 bp, Homo sapiens
  misc_feature: GYAE6OF01DDV85.24.53.E09.1.454.CMB.1.raw
  modified_base (164)..(164): a, c, t, g, unknown or other
  misc_feature (164)..(164): n is a, c, g, or t
  modified_base (186)..(186): a, c, t, g, unknown or other
  misc_feature (186)..(186): n is a, c, g, or t
  modified_base (224)..(224): a, c, t, g, unknown or other
  misc_feature (224)..(224): n is a, c, g, or t
  modified_base (525)..(525): a, c, t, g, unknown or other
  misc_feature (525)..(525): n is a, c, g, or t
  modified_base (528)..(559): a, c, t, g, unknown or other
  misc_feature (528)..(559): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgctaggttttgatgtccactggtacaagcagccttaccaaaacncgcccccaaatcctcattttancgtaacaacatccggccctgtcggggtccctgaccgtnttcctccgcctccaagtctcggcacctcagccctcgcctggaccctatccgacgtcgggcctaccgaggtcctaggacggtaagtggtaggggtacgtatttacgtacgtcgaccgtagttcgacgtaaagtggttggttcgggcggaacggtataacgcgtacgaccgtctaggtcaacggacccaaggtccctccggtcccccgttggtacctaccgttcctcccgtttccccaccccttcctacactatacgttagtctaggcgacggtcgtaggacgaacggtcacgtacgtagcancgnnnnnnnnnnnnnnnnnnnnnnnnnnnnnnnn

SEQ ID NO: 264019 - DNA, 669 bp, Homo sapiens
  misc_feature: GYAE6OF01EJ0YH.24.53.E09.1.454.CMB.1.raw
  modified_base (171)..(171): a, c, t, g, unknown or other
  misc_feature (171)..(171): n is a, c, g, or t
  modified_base (539)..(539): a, c, t, g, unknown or other
  misc_feature (539)..(539): n is a, c, g, or t
  modified_base (637)..(637): a, c, t, g, unknown or other
  misc_feature (637)..(637): n is a, c, g, or t
  modified_base (642)..(669): a, c, t, g, unknown or other
  misc_feature (642)..(669): n is a, c, g, or t
tcagactactatgtcacgaccggtgctcgatttagagagagtgtgttgggtttggggctgttttggaagctgcttgtaccagagggtcaccatctcctgcacgtgggagcaacatccggcgctaggttttgatgtccactggtaacaagcagtaccttaaccaaaaaaccnccgaccccccaaaactcccttactaattttaataccgtaaaccaaacaacgtccggtcccttcggtcggggtcccctacgaccgtactttccgccccgacctaccaagttcctcggacctaccctcgaccgcccgttcgccttcggcctactccgacggtcgggtccctaccgagggccttaggaggacgtgggtaggttacgtaacgtttaaccgtcgttaccgcccgtacgggttaccggtaggtaaacgtacggttcggggtacgggacggggaagttaacgtaacggtccgtccggtaaccccggttcgttaacggcgaacccggtcccgaacgggccctccccggtccccccttcggtacccnctttccgttacccgtacccctcccttccgtacaccgttaagtacgttccgtacgcggaccgggtccgggtcgtacggtaccggaggcctagaacgtancgtannnnnnnnnnnnnnnnnnnnnnnnnnnn

SEQ ID NO: 264020 - DNA, 704 bp, Homo sapiens
  misc_feature: GYAE6OF01BSVDZ.24.53.E09.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
tcagactactatgtcacgaccggtgctcgatttagagagagtgtgttgggtttgggaggcttggtccagcctggggggtccctgagactctcctgtgcagcctctggattccctttagtgtacttttggatgacctcgggtcccccaggctccgagggacgggcttggagtgggtgccaatataaggcacgatggacgtagcatgtactatgtggactctagtgaagggccattcaccatctccagagacaaccgccaagtaactcactgtatacgtaggaaatcgaaccagcctagagngtcgaggacncggtctatgtattactggtncgacatactcacgtacaccgtggagtccgctaacgtctagaacttaccttcgaacggtcaaggtttccggggcctacggggaccctacccgttcgggtacctaacccgttcctacccgtccgtaacgtcccctaacccgaacccggtaaccgggtacccccgtaacggtttccccggttcccgtttcccccgtcgggtccccgtccccggtaccgtacccgttacccgaacgggacccgtacccgtaccccggtacccggaacgacgaccctaccggaacggcccggtcccgtcggggtacctcgggtaccgtcggtaaccgacggtaaccttaccttacccgaactacttacggtacgttcgtaggacccggg

SEQ ID NO: 264021 - DNA, 502 bp, Homo sapiens
  misc_feature: GYAE6OF01BV7O5.24.53.E09.1.454.CMB.1.raw
  modified_base (186)..(186): a, c, t, g, unknown or other
  misc_feature (186)..(186): n is a, c, g, or t
  modified_base (301)..(301): a, c, t, g, unknown or other
  misc_feature (301)..(301): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (474)..(502): a, c, t, g, unknown or other
  misc_feature (474)..(502): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttaccaaaaaacacgcccccaaactcctcatttanccgtaacaacaatcggccctctcggggtccctgaccgattcctccgcctccaagtctggccacctcacgcctcgctcggccatcacgtgggctccaggctagaggatggagggtnattaccactgaccagtcgtacgaagagtggttcggcggagggactaagtctcgaccgtctaggtcagacccgaaggcctcgccccctggtcactctcgttccccaccctccctacactatagtacgtcgtggacggcgggctcgggacgtaacgggcgcaagtagngntnngnnnnnnnnnnnnnnnnnnnnnnnnnnnnn

SEQ ID NO: 264022 - DNA, 653 bp, Homo sapiens
  misc_feature: GYAE6OF01DP4S7.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtgactctgtgaagggccgattcaccatctccagagacaacgcccagaactcactgtatctaggaaatgaccagcctgagagtcgagacacggctatgtattactgtgcgacatatcagcactggatcgcatctagaaatcctcagctaggttgggacccgagggcctacccgtggtcctacccgtcctcctcacgtccctacccaaccgaccggcccctacgttcccggttacccttccccccgtcggtccccgccccgtcgtcccgtacccgaggacgcccgtaacccgtcccgaacgtaccgaccgaaccgtaccgggcccggtccccgggttacggggcccgtaccgggtccccgttacggggttaacccgaaaccggggtaaccccttaaccccgtttacccaaaccgttagtttaacggttcgttccgtaacgggg

SEQ ID NO: 264023 - DNA, 705 bp, Homo sapiens
  misc_feature: GYAE6OF01ESKL9.24.53.E09.1.454.CMB.1.raw
  modified_base (163)..(163): a, c, t, g, unknown or other
  misc_feature (163)..(163): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (672)..(673): a, c, t, g, unknown or other
  misc_feature (672)..(673): n is a, c, g, or t
  modified_base (675)..(678): a, c, t, g, unknown or other
  misc_feature (675)..(678): n is a, c, g, or t
  modified_base (681)..(690): a, c, t, g, unknown or other
  misc_feature (681)..(690): n is a, c, g, or t
  modified_base (692)..(705): a, c, t, g, unknown or other
  misc_feature (692)..(705): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgcccccaaatcctcattttataccgtaaacaaacaactcggacccttcgtcggggtcccctagaccgtattcctcccgcctccaaagttcgtcggccacccgttcaccgcccgtcgccgtggcctaatccaccgtgggcccttccgaggcctaggaggtattggacggggttatactttaacctcgtcggaccctaacgggttcgtacggaaaaggttgtcgggtttaccgggacggggtaacgggtaaaccgttaaacggtcccggttaggtaaccccgtttaccgggtacggttaccgaaccccggtaacccgacggggttccctccccgggtacccccgtttagggtacccctacgtttccccgttaccccggttaccccctaaccccctttcccggtaacctaacgttaaccggtttagttaccgtttaccggagggtaccggggtcccggggttacttaccgggggacctaacgggcccgttaanacggttacgngncgtcanncnnnngcnnnnnnnnnncnnnnnnnnnnnnnn

SEQ ID NO: 264024 - DNA, 652 bp, Homo sapiens
  misc_feature: GYAE6OF01CPOUJ.24.53.E09.1.454.CMB.1.raw
  modified_base (101)..(101): a, c, t, g, unknown or other
  misc_feature (101)..(101): n is a, c, g, or t
  modified_base (237)..(237): a, c, t, g, unknown or other
  misc_feature (237)..(237): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(652): a, c, t, g, unknown or other
  misc_feature (626)..(652): n is a, c, g, or t
tcagactactatgtcacgaccggtgctcgatttagagagagtgtgttgggtttgggggctgtttttggaagctgcttgtaccagagggtcaccatctcctncactgggagcaacatcggcgcaggttttgatgtccactggtacaagcagcttaccaaaaaacacgaccccccaaaactccctcattttaatcgtaaacaaacaatccggcccttcgtgggtccctgaccgacttcncccgcctaccaagtctggcacctcagcctccgctcggccatccacgtcgggcctccaagggctaggaggtacgtggtagggtgtaactttactaaccgtggaccacggttcgtaccggaaaggtagttcgggttccggggcgggtaagggtaacctaaggtcgtaccggaacccggttaccgtacggtaccgaacgaaccccgtaaacgggtcccgttccccggtaccccccgttcgggttacctacccgttcccgttcccggtttaccccccgtcccccttaccccgtttaccaaccgttacgttaaccgggttaagttcccgtacggggaacggtcccgggggtacctcggggaaacgaacgggtacccgactaagtaacgncnncnnnnnnnnnnnnnnnnnnnnnnnnnnn

SEQ ID NO: 264025 - DNA, 450 bp, Homo sapiens
  misc_feature: GYAE6OF01BTXS1.24.53.E09.1.454.CMB.1.raw
  modified_base (111)..(111): a, c, t, g, unknown or other
  misc_feature (111)..(111): n is a, c, g, or t
  modified_base (156)..(156): a, c, t, g, unknown or other
  misc_feature (156)..(156): n is a, c, g, or t
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(404): a, c, t, g, unknown or other
  misc_feature (402)..(404): n is a, c, g, or t
  modified_base (406)..(450): a, c, t, g, unknown or other
  misc_feature (406)..(450): n is a, c, g, or t
tcagactactatgtcacgaccggtgctcgatttagagagagtgtgttgggtttgggagcaacatcggcgcaggttttgatgtccactggtacaagcagcttccaaaaaacngccccccaaaactccctcatttatcgtaaacaacaatcggccctntggggtccctgaccgattcctccgcctccaagtctggcacctnagcctgctggccatcactgggctccaggctgaggntggagggtnatttactactgcccaggtcgtacgaagatggttcggcggagggactaaggctcgaccgtctaggtcagcccaaggcctcgccccctggtcactctcgtcccacctcctnacatagtagtccnggagcgggctcggcaaggccnctagtagntcgntngnnncnnnnnnnnnnnnnnnnnnnnnnnnnnnnnnnnnnnnnnnnnnnnn

SEQ ID NO: 264026 - DNA, 448 bp, Homo sapiens
  misc_feature: GYAE6OF01A8HII.24.53.E09.1.454.CMB.1.raw
  modified_base (160)..(160): a, c, t, g, unknown or other
  misc_feature (160)..(160): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (431)..(448): a, c, t, g, unknown or other
  misc_feature (431)..(448): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattcctccgcctccaagtctggcacctcagcctcgctggccatcactggctccaggctgagatgaggtnattacactgccagtcgtcgaagntgtcggcggaggataagctgaccgtcctaggtcacgcccgaagcctcgccccctggtcactctcgttccccaccctcctcactatagtatcgtgacggcgggctggacgaaggccgacagtgnnnnnnnnnnnnnnnnnn

SEQ ID NO: 264027 - DNA, 615 bp, Homo sapiens
  misc_feature: GYAE6OF01CSAN9.24.53.E09.1.454.CMB.1.raw
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
  modified_base (355)..(355): a, c, t, g, unknown or other
  misc_feature (355)..(355): n is a, c, g, or t
  modified_base (578)..(578): a, c, t, g, unknown or other
  misc_feature (578)..(578): n is a, c, g, or t
  modified_base (584)..(588): a, c, t, g, unknown or other
  misc_feature (584)..(588): n is a, c, g, or t
  modified_base (590)..(615): a, c, t, g, unknown or other
  misc_feature (590)..(615): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagccttaccaaaaacncgacccccaaactcctcattttancgtaaacaacaatccggcccttcgtcggggtccctgaccgtattcctccgcctccaagtctggccaccgtcacgcctcgctcggccattccacgtcgggacctccgaggctggaggatggtaggtgtattactacgtcgccagttcgacgaagtagtcggttccggngggaacggtaacgtaacggcgtaccggtacccgttacccgtaggtaccgaacggtacccaaacggggtcctaccccggtcccccgttacgggttccctaccgttcccgttcccgttaccccctaaccccttcctaacgaccttaagttaccggttacgtccgttacgggacgggtcccgggtacgtacgggaacggtaaacggtccggtacgtaaggtaacgngagctnnnnncnnnnnnnnnnnnnnnnnnnnnnnnnn

SEQ ID NO: 264028 - DNA, 335 bp, Homo sapiens
  misc_feature: GYAE6OF01BWHSV.24.53.E09.1.454.CMB.1.raw
  modified_base (283)..(283): a, c, t, g, unknown or other
  misc_feature (283)..(283): n is a, c, g, or t
  modified_base (314)..(335): a, c, t, g, unknown or other
  misc_feature (314)..(335): n is a, c, g, or t
tcagactactatgtcacgaccggtgctcgatttagagagagtgtggttggggtttggggggtgtggtggtctccactcccgccttgacggggctgctatctgcctcgctggccatcactggggctccaggctgaggatggagggtgattactactgccagtcgtacgaagagtggttcgggcgggagggactaagctcgaccgtctaggtcacgcccgaaggctccgccccctcggtctacttcctccgttccccaccctcctcactagtagtagtcgtaggnggccgggctagggccgaaggcgtacaagtgnnnnnnnnnnnnnnnnnnnnnn

SEQ ID NO: 264029 - DNA, 287 bp, Homo sapiens
  misc_feature: GYAE6OF01CLLO8.24.53.E09.1.454.CMB.1.raw
  modified_base (248)..(248): a, c, t, g, unknown or other
  misc_feature (248)..(248): n is a, c, g, or t
  modified_base (279)..(287): a, c, t, g, unknown or other
  misc_feature (279)..(287): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatggagggtgattactactgccagtcgtcgaagatggtcggcggaggactaagctgaccgtcaggtcagccaagctcgccctcgcactctcgtcccacctctcactatagtagtcgngacggcgggcgtggacgaaggcgactatagnnnnnnnnn

SEQ ID NO: 264030 - DNA, 696 bp, Homo sapiens
  misc_feature: GYAE6OF01BBW44.24.53.E09.1.454.CMB.1.raw
  modified_base (391)..(391): a, c, t, g, unknown or other
  misc_feature (391)..(391): n is a, c, g, or t
tcagactactatgtcacgaccggtgctcgatttagagagagtgtgttgggtttgggaggcttggtccagcccgtggggggtccctgagactctcctgtgcagcctctggattcccctttagtgtactttttggatgacctgggtccgccaggctccgagggacggggctggagtgggtggccaatataaggcacgatggacgtagcatgtactatgtggactctgtgaaggccgattcaccatctccagagacaacgccaagaactcactgtatcgtaggaaatcgaaccagcctagagagtacggaggacgacggctagtagttattacgtgtcgacgactatatcagccaccgtggacgtcgctatctagtaacttaccttcgagacgngtttcggggacccgagggccctacccgttcgggtccctacccgttcctccccgtaccgtacccgtccccgttacccgaacccgaacccggcccctaaccgttccccgggttcccctttccccccggtcgggccccgtccccgtccgccctacccgacggacccgtcccgtaacccgtcccggacgacgacccgaccgaccggtccccggcccgtcgggtaccgtccgtacccggttcggtaaccgaaaccgggttaacccttacccgttaccctaactaacgtttacggtaacgttcggtacggg

SEQ ID NO: 264031 - DNA, 287 bp, Homo sapiens
  misc_feature: GYAE6OF01DA6ZZ.24.53.E09.1.454.CMB.1.raw
  modified_base (281)..(287): a, c, t, g, unknown or other
  misc_feature (281)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttcccaccctcctcacatagtagtctgagcgggctggcaaggcgcatagnnnnnnn

SEQ ID NO: 264032 - DNA, 370 bp, Homo sapiens
  misc_feature: GYAE6OF01DWT6H.24.53.E09.1.454.CMB.1.raw
  modified_base (170)..(170): a, c, t, g, unknown or other
  misc_feature (170)..(170): n is a, c, g, or t
  modified_base (283)..(283): a, c, t, g, unknown or other
  misc_feature (283)..(283): n is a, c, g, or t
  modified_base (334)..(334): a, c, t, g, unknown or other
  misc_feature (334)..(334): n is a, c, g, or t
  modified_base (354)..(370): a, c, t, g, unknown or other
  misc_feature (354)..(370): n is a, c, g, or t
tcagactactatgtcacgaccggtgctcgatttagagagagtgtgttgggtttggggggtgtggtggtctccactcccgcttgacgggctgctatctgcctcgctggccatcacgtggctccaggctgaggatggagggtgtattactactcgccaggtcgtacgaagtnttcggttcgggacgggaggtaactaaggctcgaacccggttccgtagggtaccacggaccgaaggtcccgtcccgtcccccgtggtacctaccttcgttccccggttcccccncccttacccgtacaactaacgttaagtacgtcgtaggcggggtcggtccgnggacgtaagggcactaagcnnnnnnnnnnnnnnnnn

SEQ ID NO: 264033 - DNA, 327 bp, Homo sapiens
  misc_feature: GYAE6OF01DOO8V.24.53.E09.1.454.CMB.1.raw
  modified_base (273)..(273): a, c, t, g, unknown or other
  misc_feature (273)..(273): n is a, c, g, or t
  modified_base (305)..(327): a, c, t, g, unknown or other
  misc_feature (305)..(327): n is a, c, g, or t
tcagactactatgtcacgaccggtgctcgatttagagagagtgtgttggggtttggggggtgtggtggtctccactcccgccttgacggggctgctatctgcctcgctggccatcactgggcctccaggctgaggatggaggtgattactactcgccagtcgtacgaagtatggtcgggacggagggactaagctcggacccgtcgtaggtcacgcccaaggcctcgccccctgtccacttctcctccccaccctcctcactattagtacgtnggaggccggcgtcggacgaaggccgatatagnnnnnnnnnnnnnnnnnnnnnnn

SEQ ID NO: 264034 - DNA, 318 bp, Homo sapiens
  misc_feature: GYAE6OF01ALLTU.24.53.E09.1.454.CMB.1.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (305)..(318): a, c, t, g, unknown or other
  misc_feature (305)..(318): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatggttcggcggagggactaagctgaccgtctaggtcacgcccgaaggctccgtccccctcggtccactcctcgttccccacccctcctcacagttacgttagtctggacggcgggtcgnggacgaggccganaagtgnnnnnnnnnnnnnn

SEQ ID NO: 264035 - DNA, 499 bp, Homo sapiens
  misc_feature: GYAE6OF01C51OU.24.53.E09.1.454.CMB.1.raw
  modified_base (164)..(164): a, c, t, g, unknown or other
  misc_feature (164)..(164): n is a, c, g, or t
  modified_base (190)..(190): a, c, t, g, unknown or other
  misc_feature (190)..(190): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (481)..(499): a, c, t, g, unknown or other
  misc_feature (481)..(499): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgaccccccaaaactcctcattttancgtaaacaacaatccggccctcgtcggggtccctgaccgattcctcccgcctccaagtctggccacctcagccctgctgccatcacgtggctcgaggctggaggatggagggtnattacactgcctagtcgtcgaaagtntcggttcggnggaggtactagctcgaccgtctaggcacgcccgaaggcctccgcccccttggtcctaccgttcccgttcccccaaccctcctacaactagttacggttacgtcgtaggacgggccgggtacgtggacgaggcgactagagnnnnnnnnnnnnnnnnnnn

SEQ ID NO: 264036 - DNA, 590 bp, Homo sapiens
  misc_feature: GYAE6OF01EVZVW.24.53.E09.1.454.CMB.1.raw
  modified_base (164)..(164): a, c, t, g, unknown or other
  misc_feature (164)..(164): n is a, c, g, or t
  modified_base (192)..(192): a, c, t, g, unknown or other
  misc_feature (192)..(192): n is a, c, g, or t
  modified_base (556)..(557): a, c, t, g, unknown or other
  misc_feature (556)..(557): n is a, c, g, or t
  modified_base (559)..(590): a, c, t, g, unknown or other
  misc_feature (559)..(590): n is a, c, g, or t
tcagactactatgtcacgaccggtgctcgatttagagagagtgtgttggggtttgggggctgtttttggaagctgcttgtaccagagggtcaccatctcctgcactgggagcaacatcggcgcaggttttgatgtccactggtacaagcagcttccaaaaaacncgaccccccaaaactccctcaattttanccgtaaacaacaatcggccctcgtcggggtcccctggaccgattcctccgcctccaagtctggcacctcagccctcgctggccatcacgtggctccaggctgaggatggagggtgtattactacgtgccagtcgtacgaagtagtggttcgggcggagggtaactaacgggtcttacggaccccgttccgtaagggtccaacggtccccgaaagggccttccggcccccccgtttacgggtaccctaccgttcccgttaccggttccccccctaacccccttccctacctaacgtaacgtttacggtacgttcccgtaggacgggccggggtactcgggaccgaacgggtccgactaagtacgnngnnnnnnnnnnnnnnnnnnnnnnnnnnnnnnnn

SEQ ID NO: 264037 - DNA, 518 bp, Homo sapiens
  misc_feature: GYAE6OF01B2E1O.24.53.E09.1.454.CMB.1.raw
  modified_base (162)..(162): a, c, t, g, unknown or other
  misc_feature (162)..(162): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (496)..(518): a, c, t, g, unknown or other
  misc_feature (496)..(518): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagtagcttaccaaaaacncgacccccaaactcctctatttatcgtaaacaacaatccggcccctcgtcggggtccctagaccgtattcctcccgccctccaagtctcggccacctcacgccctcgctcggccagtcgcgtgggcctccgaggtctgaggntggaggtgattactacngccagtcgtacgaagagtggtcggaggaggactagctagaccgtcgacgtacacgccgaaggtcctccgtccccgtcggtcctacgttccgttacccgttccccgcccttcctacctactacgttacgtacgtccgtacgggacggtcgggacgtcgacgacggcagagtagcgnnnnnnnnnnnnnnnnnnnnnnn

SEQ ID NO: 264038 - DNA, 289 bp, Homo sapiens
  misc_feature: GYAE6OF01COJB9.24.53.E09.1.454.CMB.1.raw
  modified_base (142)..(142): a, c, t, g, unknown or other
  misc_feature (142)..(142): n is a, c, g, or t
  modified_base (282)..(289): a, c, t, g, unknown or other
  misc_feature (282)..(289): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtnattactactgccagtcgtcgaagatgttcgggcggagggactaagctgaccgtctaggtcagccagctcgcccctgtcactctcgtcccaccctctcacatagtagtctgagccggggcttgggcaaggcgacatagcannnnnnnn

SEQ ID NO: 264039 - DNA, 716 bp, Homo sapiens
  misc_feature: GYAE6OF01CTGQA.24.53.E09.1.454.CMB.1.raw
  modified_base (670)..(670): a, c, t, g, unknown or other
  misc_feature (670)..(670): n is a, c, g, or t
  modified_base (680)..(680): a, c, t, g, unknown or other
  misc_feature (680)..(680): n is a, c, g, or t
  modified_base (682)..(702): a, c, t, g, unknown or other
  misc_feature (682)..(702): n is a, c, g, or t
  modified_base (704)..(716): a, c, t, g, unknown or other
  misc_feature (704)..(716): n is a, c, g, or t
tcagactactatgtcacgaccggtgctcgatttagagagagtgtggttgggtttgggggatgtttttggaagctgcttgtaccagagggtcaccatctcctgcactgggagcaacatcggcgcaggtttttgatgtccactggtacaagcagctttaccaaaaaacacgaccccccaaaacttcctacattttaatcgtaaacaacaactcggcccttcgtcggggtcccctggaacccgattccgtcccgtccctaccaaagtccttcggccacctcgacgccctccgacttcggacccattccgaacttcggggccctaccgaggcctaggacggtataggacggggtataaacgtttacgtaaccgttacggacccgtaaaggtttccgggtaaaccgtaaaaggtaacgtttcggggttttacccggggtacgggaaacgggggtaaacttaaaacggtcccggtacggtaaacccccggtttacgtaacgggttaccgacggtaaccccgaaacgggtcccgtcccgtaccccccgtacgggtttcccaaccggtttcccgttccggtttaccccccgcccccctttaccgtaccaacgtaactttaacggtacgttccgttacggaacgggaccgggtaggttcgggaacgtaaacggccgtanaaacgtacgncnnnnnnnnnnnnnnnnnnnnngnnnnnnnnnnnnn

SEQ ID NO: 264040 - DNA, 338 bp, Homo sapiens
  misc_feature: GYAE6OF01DLBZR.24.53.E09.1.454.CMB.1.raw
  modified_base (142)..(142): a, c, t, g, unknown or other
  misc_feature (142)..(142): n is a, c, g, or t
  modified_base (324)..(338): a, c, t, g, unknown or other
  misc_feature (324)..(338): n is a, c, g, or t
tcagactactatgtcacgaccggtgctcgatttagagagagtgtgttgagtttgggggtgtggtggtctccactcccgccttgacgggctgctatctgcctcgctggccatcactgggctccaggctggaggatggagggtnattactactgccagtcgtacgaagtagtggttcgggcgggaagggaactaaggctacgaccgtcgtaggcacgaccgaaggtcctcccgccccgtacggtcctaccgttcgttcccgtttccccgcccctcctacaactagtaggttagtcgaggcggcggtcgtacggagacggcatatgnnnnnnnnnnnnnnn

SEQ ID NO: 264041 - DNA, 315 bp, Homo sapiens
  misc_feature: GYAE6OF01EQADH.24.53.E09.1.454.CMB.1.raw
  modified_base (295)..(295): a, c, t, g, unknown or other
  misc_feature (295)..(295): n is a, c, g, or t
  modified_base (297)..(315): a, c, t, g, unknown or other
  misc_feature (297)..(315): n is a, c, g, or t
tcagactactatgtcacgaccggtgctcgatttagagagagtgtgttgggtttgggggtgtggtggtctccactcccgccttgacggggctgctatctgcctcgctggccatcactgggctccagctgagatgagggtgattactactgccagtcgtcgaagatggttcggcggagggactaagctgaccgtcctaggtcacgccccaaggcctcgccccctcggtccactcctcgttccccaccctcctacaacattagtagtctggacgcgggtctggacaaggcgacatagnannnnnnnnnnnnnnnnnnn

SEQ ID NO: 264042 - DNA, 277 bp, Homo sapiens
  misc_feature: GYAE6OF01AMBC7.24.53.E09.1.454.CMB.1.raw
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctcgcccctggtcactctcgttccccaccctcctcacatatagtcngagcgggctggcaaggcncatgn

SEQ ID NO: 264043 - DNA, 636 bp, Homo sapiens
  misc_feature: GYAE6OF01CT9L2.24.53.E09.1.454.CMB.1.raw
  modified_base (163)..(163): a, c, t, g, unknown or other
  misc_feature (163)..(163): n is a, c, g, or t
  modified_base (610)..(636): a, c, t, g, unknown or other
  misc_feature (610)..(636): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgatgtccactggtacaagcagccttaccaaaaacncgccccccaaactcctcatttatcgtaacaacaatcgccctcgtcggggtccctgaccgattcctccgcctccaagtctggccaccctcacgcctcgcgtcggccatccagtcgggcctccgaggctaggaggagtggagggtgtaatttacctacgtcgaccgtacggtaccgtacggaagtacgtcggtttaccgggggacgggtacgggtaacgtaacggccgtacggtaccccggtaccgttaacgggtccaccggtacccccgaacgggtcccgtccccggtcccccccgtgggttccctaccgtttccccgttaccccgtttccccccctaacccccgtttcccttacccaaccgttaagtttaaccggtttacgtcccggttacggggaacgggtcccggggtacgtccgggacggaaacgggcccgtacaagttagctnnnnnnnnnnnnnnnnnnnnnnnnnnn

SEQ ID NO: 264044 - DNA, 296 bp, Homo sapiens
  misc_feature: GYAE6OF01DD91G.24.53.E09.1.454.CMB.1.raw
  modified_base (142)..(142): a, c, t, g, unknown or other
  misc_feature (142)..(142): n is a, c, g, or t
  modified_base (283)..(296): a, c, t, g, unknown or other
  misc_feature (283)..(296): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtnattactactgccagtcgtcgaagatgttcggcggagggactaagctgaccgtcctaggtcagcccaaggctcgccccctcggtcactctcgtcccgccctcctcacatagtagtctgagcgggctggcaaggcacatagcnnnnnnnnnnnnnn

SEQ ID NO: 264045 - DNA, 612 bp, Homo sapiens
  misc_feature: GYAE6OF01DJ0L8.24.53.E09.1.454.CMB.1.raw
  modified_base (166)..(166): a, c, t, g, unknown or other
  misc_feature (166)..(166): n is a, c, g, or t
  modified_base (191)..(191): a, c, t, g, unknown or other
  misc_feature (191)..(191): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (582)..(612): a, c, t, g, unknown or other
  misc_feature (582)..(612): n is a, c, g, or t
tcagactactatgtcacgaccggtgctcgatttagagagagtgtgttgggtttgggggctgttttggaagctgcttgtaccagagggtcaccatctcctgcacgtgggagcaaacagtcggcgctaggttttgatgtccagtggtacaagcagcttaccaaaaacncgacccccaaactcctctaatttanacgtaaacaacaagtccggccctcgtcggggtccccttgaccgtattccgtccgccctccgaagtctcggccacctcacggtcctcgcgtcggccagtcacgtcgggactccgaggctaggagtgtggacgggtntacttacctagcgccgtagttacgtacgaagngttcgggtacgggacgggtaacggtaactaaggtccgttacggacccggtttaccgtaacggccgaaccggaccgaaccgggtcctccccggtcccccgtacggtacctccgtttccggtcccctttaaccccccgcctccctacaacgttacttacgggttaaccgttgaccgggacggggacccgcggtaaagggccggaacggtccgattaaggngcgntnnnnnnnnnnnnnnnnnnnnnnnnnnnnnnn

SEQ ID NO: 264046 - DNA, 292 bp, Homo sapiens
  misc_feature: GYAE6OF01CF7EL.24.53.E09.1.454.CMB.1.raw
  modified_base (284)..(292): a, c, t, g, unknown or other
  misc_feature (284)..(292): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtgaagatgttcggcggagggactaagctgaccgtcctaggtcagcccgaaggctcgccccctggtcactctcgttccccaccctcctcacatagtagtctggagcgggctggcaaggcgcatagnnnnnnnnn

SEQ ID NO: 264047 - DNA, 953 bp, Homo sapiens
  misc_feature: GYAE6OF01C67Z4.24.53.E09.1.454.CMB.1.raw
tcagactactatgtcacgaccggtgctcgatttagagagagtgtgttgggtttggaggtctcagagaggagccttagccctggagtccaaggtcctttccacttggtgatcagcactgagcacagaggactcaccatggaagttgggctgagtcgttgggttttccttgttgtacttagttttaagaggtgtccagtgtgaggtgctaacgtggtggaggtcggtgggggacgtcgttcgggtccacggtccggttcggggggttcccctaggtacgtaccttcctccgtaggtcgacgtacgtcccttcgtcggtacctttaccccgtttagttcgttaccgttttaggtacgtcgtaccccgtgggtcccgaccgtcggtccgtaccggacggggacgggcggtgggtacggtggggtacggtaaccgtaaattaacggggggggggtaaacaccgtaacgtacgttaacggtaacggtacgtacgtaagttacgttaaacgttaggtacgggttacggtaccgttaccggttaggttaacgggtaaccggggtacccgtaaccgtttacccgtaacccttaaccgttaccccgttaacccggtaaacgaaacccgtaaaaccccgaaaccccggtaccccgtaaaaccggtaacccctttaaccgtaaaccgttaaccggtttaaccgtttaaccgtaaaccgggttaaactacccggtaaacccggttaacgtacccggtaaaccgggtaacggtaacggggttaacccgggtaaaccgggtaacccggtacccgggttaacgttttaaccggttaaccgtttaaacgtttaacccggttacgggttaacccgggtaacccttaaaaccggttaccttaaaccggtaaccgtaacccggtaacccgttacccgggtacgggtaacccggtcccgggtaaccttaaccgg

SEQ ID NO: 264048 - DNA, 790 bp, Homo sapiens
  misc_feature: GYAE6OF01AWD4N.24.53.E09.1.454.CMB.1.raw
  modified_base (189)..(189): a, c, t, g, unknown or other
  misc_feature (189)..(189): n is a, c, g, or t
tcagactactatgtcacgaccggtgctcgatttagagagagtgtgttgggtttggggaggcttggtccagcctggggggtccctgagactctcctgtgcagcctctggacttcccctttagtgtacttttggatgaccgtgggtccgccaggctccgaggggacgggctggagtgggtggaccaattanaaggcacgagtggacgtagcatgtactatggtggactcgtgtgaacgggccgattccaccatcctaccagaacgaccaaccggccccaagaacctcaccttagttaactcgtacggaaaatcggaacccgagacccttaggaggtacggtacggacggacaccgggtacttacgttagttaactttaccgtggtacgtacccgaactagtacttacgacggtaccgtaaccgtaggtaacggttcccgacttaagttacctagtaaaccttaccgtttccaacgggtcctaaagggtttcccgggggaacctacgggggaccctaccccggttacggtacccgtaaccccggtttccgtaccccgttacgacccggtacccctacccggaacccgtaaccgggacccctacggttccccggttaccctccccggtacggcccgtcccgtacgccgtaccgaacggtcccgacccgtacccgtccgacggtaccgacctacggaccgggtcccggtacccggtcgggcccgttacggcccggtacggtacccgtaaacggaccctttaccctaccgtaacgttactaacgtggtcgtacggg

SEQ ID NO: 264049 - DNA, 285 bp, Homo sapiens
  misc_feature: GYAE6OF01BY350.24.53.E09.1.454.CMB.1.raw
  modified_base (279)..(285): a, c, t, g, unknown or other
  misc_feature (279)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnnnnn

SEQ ID NO: 264050 - DNA, 563 bp, Homo sapiens
  misc_feature: GYAE6OF01B49CP.24.53.E09.1.454.CMB.1.raw
  modified_base (167)..(167): a, c, t, g, unknown or other
  misc_feature (167)..(167): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (537)..(563): a, c, t, g, unknown or other
  misc_feature (537)..(563): n is a, c, g, or t
tcagactactatgtcacgaccggtgctcgatttagagagagtgtgttgggtttgggggctgtttttggaagctgcttgtaccagagggtcaccatctactgcactgggagcaacatcggcgcttttaggttttgatgtccactggtacaagcagcttaccaaaaacncgaccccccaaactccctctattttatacgtaaacaacaatccggcccctcgtcggggtccctagacccgtacttcctcccgccctaccaagtctggccacctcacgccctcgctcggccatcacgtgggcctccaggctgagntggaggtnattctactcgcagtcgtcgaagtntggttcgggnggaggtactagctagcccgtcgtacggtcacgacccgaaggcctcccggtcccccgtcggtacctaccgttcccttccgttacccccaccccgttccctacgaactagttacggttacgtcgttacggaccgggtcggggtaccgtacggggaccgtaaacgggccgtacgaagttagagctgnnnnnnnnnnnnnnnnnnnnnnnnnnn

SEQ ID NO: 264051 - DNA, 558 bp, Homo sapiens
  misc_feature: GYAE6OF01D2ENI.24.53.E09.1.454.CMB.1.raw
  modified_base (429)..(429): a, c, t, g, unknown or other
  misc_feature (429)..(429): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtgccaatataaggcacgatggacgtagcatgtactatgtggactctgtgaagggccattcaccatctccagagacaacgcccagaactcactgtatctggaaatgaccagcctgagagtcgaggacacggctatgtattactgtgcgaccatatcagcactggagtcgcatctagaatacttccagcagttcgggcagggcacctgtcaccgtctcctcacgcctccacgaacggcccactccggtccttcccccgnggtcccgcccgtcgcctccgacggacgcctacctcccgagacgccgaccgacgccggtaccccgtgggaccgtcgcccgtggtcccgaacggtaccttaaccgttccaacattaacggtgtcgtacggg

SEQ ID NO: 264052 - DNA, 289 bp, Homo sapiens
  misc_feature: GYAE6OF01ASLC8.24.53.E09.1.454.CMB.1.raw
  modified_base (281)..(289): a, c, t, g, unknown or other
  misc_feature (281)..(289): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctggagcgggctggcaaggcgcatagnnnnnnnnn

SEQ ID NO: 264053 - DNA, 589 bp, Homo sapiens
  misc_feature: GYAE6OF01AH1LI.24.53.E09.1.454.CMB.1.raw
  modified_base (163)..(163): a, c, t, g, unknown or other
  misc_feature (163)..(163): n is a, c, g, or t
  modified_base (318)..(318): a, c, t, g, unknown or other
  misc_feature (318)..(318): n is a, c, g, or t
  modified_base (565)..(589): a, c, t, g, unknown or other
  misc_feature (565)..(589): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgcccccaaactcctcatttatcgtaaacaaacaactccggccctcgtcggggtcccctgacccgtattcctcccgcctccaagtcctcggccacctcacgcctcgctcggccatccacgtcgggcctccgaggtcctggaggtatgggagggtntaacttacctacgtcgccgtaggtccgtacggaagtagttcgggttaccgggacgggtaagggaacctaacggcgtaccggtacccgttacgtacggtaccgaccgaccccgtaagggtccctcccggtccccccgtggtccctaccgttcccgttcccgtacccccctaccccgttccctacaacgtacgtttacgtacgtcggtcggacggccgggtacgtcgggaccgacggccgacagtagcnnnnnnnnnnnnnnnnnnnnnnnnn

SEQ ID NO: 264054 - DNA, 335 bp, Homo sapiens
  misc_feature: GYAE6OF01DHVF3.24.53.E09.1.454.CMB.1.raw
  modified_base (146)..(146): a, c, t, g, unknown or other
  misc_feature (146)..(146): n is a, c, g, or t
  modified_base (327)..(335): a, c, t, g, unknown or other
  misc_feature (327)..(335): n is a, c, g, or t
tcagactactatgtcacgaccggtgctcgatttagagagagtgtgttgggtttggggggtgtggtggtctccactcccgccttgacggggctgctatctgcctcgctggccatcacgtgggcctccaggctgaggatggaggggtntaatttactactcgcctagttcgtacgaagagttggttcgggacgggagggaactaagctcgtaccgtcgtaggtcacgaccaaggtcctccgtcccccgtggtcctaccttcttccgtaccccaccctcctacaactagttacgtagtcgtggacggcggtgacggacgacggcagatannnnnnnnn

SEQ ID NO: 264055 - DNA, 284 bp, Homo sapiens
  misc_feature: GYAE6OF01ANOXY.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgagatgagggtgattactactgccagtcgtcgaagatgttcggcggagggactaagctgaccgtcctaggtcagcccaaggctcgccccctggtcactctcgttccccaccctcctcacatagtagtctgagcgggctggacaaggcgcaatgnnnn

SEQ ID NO: 264056 - DNA, 508 bp, Homo sapiens
  misc_feature: GYAE6OF01C6IAX.24.53.E09.1.454.CMB.1.raw
  modified_base (137)..(137): a, c, t, g, unknown or other
  misc_feature (137)..(137): n is a, c, g, or t
  modified_base (144)..(144): a, c, t, g, unknown or other
  misc_feature (144)..(144): n is a, c, g, or t
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (448)..(450): a, c, t, g, unknown or other
  misc_feature (448)..(450): n is a, c, g, or t
  modified_base (453)..(453): a, c, t, g, unknown or other
  misc_feature (453)..(453): n is a, c, g, or t
  modified_base (456)..(458): a, c, t, g, unknown or other
  misc_feature (456)..(458): n is a, c, g, or t
  modified_base (463)..(508): a, c, t, g, unknown or other
  misc_feature (463)..(508): n is a, c, g, or t
tcagactactatgtcacgaccggtgctcgatttagagagagtgtgttggggtttgggggcaacatcggcgctaggttttgatgtccactggtacaagcagccttaccaaaaaccgccccccaaatcctctattttanccgtaanaaccaagtccggccctacgtgggggtcccctggacccgtatttccgcccgcctccaagtcctggccacctcancccgtcgctggccatccaaccgtgggctccgaggctggaggatggaagggtntattacctgngacccgtagtccggtanaagtctcggttcgggacggtaggacttaaggctggtaccnccgttaggccaggaccaaggtccncgccccctggtccactctcgttaccccncttcncgatactggacgttcgngacgtcggggctaggcccaaaggggcctagagngangnnnccnttnnntacgnnnnnnnnnnnnnnnnnnnnnnnnnnnnnnnnnnnnnnnnnnnnnn

SEQ ID NO: 264057 - DNA, 755 bp, Homo sapiens
  misc_feature: GYAE6OF01ENJJ4.24.53.E09.1.454.CMB.1.raw
tcagactactatgtcacgaccggtgctcgatttagagagagtgtgttgggtttgggaggcttggtccagcctggggggtccctgagactctcctgtgcagcctctggacttcccctttagtgtactttttggatgacctgggtccgccaggctccgagggcgggctggagtgggtggccaatataaggcacgatggactagcatgtactatgtggactctgtggaacgggccattccacatcctccagagacacgccagactcactgtatctagaaatgaccagcctgagacgtcgagacacggcttagtgtattacgtgtcgaccgacatactacgacgacctaaccgtgggacgtcgactagttcgtagtaaactttaccgttacccgaaggtcctaagggtttccgggggacccgtacggggtacccctaacccggtttcggtcccgtaaccccgttcccttaccccttaccgacccgtaccccgttaccccgaacccggaacccgggtacccccgttaacggttccccggtttcccccgtttcccccccggtccgggtcccccgtcccccgtccggtacccgttacccggaaccgggcccgtaccccgtaacccgttaccccggaacgtacccgaccgaacccggaccgggtccccggccccggtaccgggtcgtccgggtacccgttacggtacggtaacccggtaaccttaccgttacccaacgttagttaaacggtcgtcggtacggg

SEQ ID NO: 264058 - DNA, 365 bp, Homo sapiens
  misc_feature: GYAE6OF01C7NEN.24.53.E09.1.454.CMB.1.raw
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (302)..(365): a, c, t, g, unknown or other
  misc_feature (302)..(365): n is a, c, g, or t
tcagactactatgtcacgaccggtgctcgatttagagagagtgtgttggggtttggggggtgtggtggtctccactcccgccttggacggggctgctatctgcctcgctggccatcactgggctccaggctgaggatggagggtgattactactgccagtcgtcgaagatggtcggcgggaagggactaagctgaccgtctaggtcacgcccaaggcctcgccccctgtcacttctcgttccccaccctcctcacatagtagtcnggacgcggctggcgaaaggccgtanaatagncanctnnnnnnnnnnnnnnnnnnnnnnnnnnnnnnnnnnnnnnnnnnnnnnnnnnnnnnnnnnnnnnnn

SEQ ID NO: 264059 - DNA, 451 bp, Homo sapiens
  misc_feature: GYAE6OF01E15AL.24.53.E09.1.454.CMB.1.raw
  modified_base (162)..(162): a, c, t, g, unknown or other
  misc_feature (162)..(162): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (433)..(451): a, c, t, g, unknown or other
  misc_feature (433)..(451): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactccctcatttatcgtaaacaacaatcggccctctggggtccctgaccgattctccgcctccaagtctggcacctcagcctcgctggccatcactggctccaggctgagatgaggtnattactactgccagtctcgaagntggtcggcggaggactaagctgaccgtctaggtcagcccaagctcgcccctggtcactctcgtcccaccctctcacattagtacgtctggagccgggctcgggactaacggccgacatagnnnnnnnnnnnnnnnnnnn

SEQ ID NO: 264060 - DNA, 648 bp, Homo sapiens
  misc_feature: GYAE6OF01BD6Z1.24.53.E09.1.454.CMB.1.raw
  modified_base (163)..(163): a, c, t, g, unknown or other
  misc_feature (163)..(163): n is a, c, g, or t
  modified_base (312)..(312): a, c, t, g, unknown or other
  misc_feature (312)..(312): n is a, c, g, or t
  modified_base (605)..(605): a, c, t, g, unknown or other
  misc_feature (605)..(605): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
  modified_base (614)..(615): a, c, t, g, unknown or other
  misc_feature (614)..(615): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (628)..(631): a, c, t, g, unknown or other
  misc_feature (628)..(631): n is a, c, g, or t
  modified_base (636)..(638): a, c, t, g, unknown or other
  misc_feature (636)..(638): n is a, c, g, or t
  modified_base (640)..(641): a, c, t, g, unknown or other
  misc_feature (640)..(641): n is a, c, g, or t
  modified_base (643)..(648): a, c, t, g, unknown or other
  misc_feature (643)..(648): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgaccccccaaactcctcatttatcgtaacaacaatcggccctctcggggtccctgaccgtattcctccgcctccaagtctggccacctcacgcctcgctggccatcacgtcgggctccgagctggaggatggaggtgtacttactacncggcctaggtcgtacggaagtggttcggttccggggacgggacggggtaacttaacgccgtacggtaccccgttcgtaacgggtcccaacggccccgaaagggtcccgtcccggtccccccgtttacgggttaccctaaccggtttccctttcccgggtttaccccccctaccccctttaccctaccgtaaccttaacggtttaacggttacgttaccggtcggggtaccgggtacccggggcccggttacgggacggtaaaccgggccgtaaccgtacgttaacggctacgncgcngcncnngcgtcncngntcnnnnatgcnnngnngnnnnnn

SEQ ID NO: 264061 - DNA, 587 bp, Homo sapiens
  misc_feature: GYAE6OF01EV96A.24.53.E09.1.454.CMB.1.raw
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
tcagactactatgtcacgaccggtgctcgatttagagagagtgtgttgggtttggggggtgtggtggtctccactcccgccttgacggggctgctatctgcctcgctggccatcactggcctccaggctgaggatgagggtgattactacgtgccagtcgtcgaagtatgttcggcgagggactagctcgtaccgtctaggtcagcccaggctcgccccctggtcacctcctcgttccccacctcctacacgtatagtagttcaggtacgcggggtactgggaccaagggcctcgaatacggnanactgactcagccagttcncgatagcncgtactagcatgtactgtancncactacgacgacgtcgtcactcgtacgtacgtacgacgagctcgacgtactcacgtacgacgtacgtagtacgtacgtacgtacgtagtagtacgtatacgtacgtacgtacgtatacgtacgtacgtacggtacgtacgacgacgtacgaccgtacgtacgtacgtacgtaccgtacggtacgtaggtaccgtacgacgtacgtacgtacgacgtactaactcgtaccgtacg

SEQ ID NO: 264062 - DNA, 293 bp, Homo sapiens
  misc_feature: GYAE6OF01D1YAL.24.53.E09.1.454.CMB.1.raw
  modified_base (285)..(293): a, c, t, g, unknown or other
  misc_feature (285)..(293): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctcgttccccgccctcctcacatagtagtctgagcgggctgggacaaggcgcatagnnnnnnnnn

SEQ ID NO: 264063 - DNA, 286 bp, Homo sapiens
  misc_feature: GYAE6OF01BIRXS.24.53.E09.1.454.CMB.1.raw
  modified_base (284)..(286): a, c, t, g, unknown or other
  misc_feature (284)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaaggctcgccccctcggtcactctcgttccccgccctcctcacatagtagtctgagcgggctggcaaggcgcatagnnn

SEQ ID NO: 264064 - DNA, 543 bp, Homo sapiens
  misc_feature: GYAE6OF01EQJOL.24.53.E09.1.454.CMB.1.raw
  modified_base (162)..(162): a, c, t, g, unknown or other
  misc_feature (162)..(162): n is a, c, g, or t
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (506)..(506): a, c, t, g, unknown or other
  misc_feature (506)..(506): n is a, c, g, or t
  modified_base (510)..(543): a, c, t, g, unknown or other
  misc_feature (510)..(543): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacagcagcttaccaaaaacncgaccccccaaactccctcattttataccgtaaacaaacaatccggcccttcgtcggggtccctgaccgtattccncccgcctccaagtctggcacctcacgcctcgctggccactcacgtgggcctccgaggctaggagntggagggtnacttacacgtcgccagtcgtacgaagnttcggttcgggcgggaagggactaaggctacggtaccgtccgtaggcacgcccaaggcctccgccccgtggtcnctccgttccgtcccctaccctcctacaactagttacgtacgttccgtaggacggccggggtcgtacgggaccgaacgggccgacaacgtaggntacnnnnnnnnnnnnnnnnnnnnnnnnnnnnnnnnnn

SEQ ID NO: 264065 - DNA, 836 bp, Homo sapiens
  misc_feature: GYAE6OF01EFQR0.24.53.E09.1.454.CMB.1.raw
tcagactactatgtcacgaccggtgctcgatttagagagagtgtgttgggtttgggaggcttggtccagcctggggggtccctgagactctcctgtgcagcctctggactttcccctttagtgtactttttggattcgaccgtcgggtccgccaggctccgaggggacggggctggagtgggtggccaatataaggcacgatggacgtagcatgtactagtgtggactcgtggtagaacgggccattccaacctatcctaccaagacgaccaaccgacccaagaacctcactgtactcgtaggaaactcggaaccagtaccgtggaacggcggtaccggaacggaccgacgggtacttaagttacggtttaactttaccgtgggtaccggaccctaacctaagttacctacgaaccggtcctaaccggttggggacgttccacgttaaacttcgtaaacggttaaactttacccgttaccaaggttaccggtacggtttaccgggggaccacgggtccctaacccgggttcggtacccgtacccgttccctccgtaccgtacccgtaccccgtaacccggaaccggtaacccgggaccccttaccggtttaccccggttcccccgtttacccccggcgggtcccccgtaccccgttgtaccccggaccgaccgggtaccgcccctaacccgtacggaccggaaccgacccgaacggtacccgggcccgggtcccggtagggtcccttaccgggtacccggttaccgggtaaacgtaaacccggttaccctaaacccggttaccaacgtaacgtttacggtccgttcggtaacgggg

SEQ ID NO: 264066 - DNA, 370 bp, Homo sapiens
  misc_feature: GYAE6OF01EDFMF.24.53.E09.1.454.CMB.1.raw
  modified_base (150)..(150): a, c, t, g, unknown or other
  misc_feature (150)..(150): n is a, c, g, or t
  modified_base (192)..(192): a, c, t, g, unknown or other
  misc_feature (192)..(192): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (332)..(370): a, c, t, g, unknown or other
  misc_feature (332)..(370): n is a, c, g, or t
tcagactactatgtcacgaccggtgctcgatttagagagagtgtggttggggtttggggggtgtggtggtctccactcccgccttggacggggctgctatctgcctcgctggaccatcacgtgggcctccgaggctgaggatggagggtntattactactcgacctaggtcgtacgaagtagtggtcggggnggagggactaagctacgaccgttccgtaggtccaacgcccaagggtcctccgccccctggtcctaccgttcctccgtccccctccctacctcaactagttacggtacgtcgagcgggtcggcgaggacgaggcanagngnnnnnnnnnnnnnnnnnnnnnnnnnnnnnnnnnnnnnnn

SEQ ID NO: 264067 - DNA, 324 bp, Homo sapiens
  misc_feature: GYAE6OF01AUFIM.24.53.E09.1.454.CMB.1.raw
  modified_base (306)..(324): a, c, t, g, unknown or other
  misc_feature (306)..(324): n is a, c, g, or t
tcagactactatgtcacgaccggtgctcgatttagagagagtgtgttggggtttggggggtgtggtggtctccactcccgccttgacggggctgctatctgcctcgctggccatcactgggctccaggctgaggatggagggtgattactactgccagtcgtcgaagatggttcggcgggagggactaagctggaccgtctaggtcacgcccaaggcctcgcccctcgtcactctcgttcccaccctcctcacatagtacgtctaggacggccgggtcgtcgggacgaacgggcgacgtaatagcnnnnnnnnnnnnnnnnnnn

SEQ ID NO: 264068 - DNA, 287 bp, Homo sapiens
  misc_feature: GYAE6OF01DT25G.24.53.E09.1.454.CMB.1.raw
  modified_base (282)..(287): a, c, t, g, unknown or other
  misc_feature (282)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgatttactactgccagtcgtcgaagatgttcggcggagggactaagctgaccgtcctaggtcagcccaaggctcgccccctggtccactctgttccccgccctcctcacatagtagtctgagcggctggcaaggcgcatagnnnnnn

SEQ ID NO: 264069 - DNA, 574 bp, Homo sapiens
  misc_feature: GYAE6OF01AU31Q.24.53.E09.1.454.CMB.1.raw
  modified_base (307)..(307): a, c, t, g, unknown or other
  misc_feature (307)..(307): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(544): a, c, t, g, unknown or other
  misc_feature (543)..(544): n is a, c, g, or t
  modified_base (546)..(574): a, c, t, g, unknown or other
  misc_feature (546)..(574): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactcctcatttatcgtaaacaacaatccggccctcgtcggggtccctgaccgtattcctccgcctccaagtctggccacctcacgccctcgctcggccatcgacgtgggctccgaggcgtggaggatggagggtntacttacctacgcgcctaggtcgtacgaagtagttggttcgggacgggagggactaaggtccgtcggtaacccgtccgtaagggtccacgaccccaagtcgacccttccgcccccgtcggtacctacctccgttacccgttcccccacccgtccctcgtaacctagttacgtacgttccggtacggacgggtccgggcgtacgggaccgtaacgggacgacgtaactacgngncgnngnnnnnnnnnnnnnnnnnnnnnnnnnnnnn

SEQ ID NO: 264070 - DNA, 260 bp, Homo sapiens
  misc_feature: GYAE6OF01DXKD5.24.53.E09.1.454.CMB.1.raw
  modified_base (160)..(160): a, c, t, g, unknown or other
  misc_feature (160)..(160): n is a, c, g, or t
  modified_base (252)..(260): a, c, t, g, unknown or other
  misc_feature (252)..(260): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccatggtacaagcagcttaccaaaaacncgaccccaaactcctctatttatacgaaacaacaagtccggccctcgtcgggtccctgacctcttctccgctaccagtctgcacctcgccgnnnnnnnnn

SEQ ID NO: 264071 - DNA, 304 bp, Homo sapiens
  misc_feature: GYAE6OF01BG0ZX.24.53.E09.1.454.CMB.1.raw
  modified_base (297)..(304): a, c, t, g, unknown or other
  misc_feature (297)..(304): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtccacttcctcgttccccaccctcctcactagtagtacgtctggaggccggggtctggaccaagggccgcatgnnnnnnnn

SEQ ID NO: 264072 - DNA, 498 bp, Homo sapiens
  misc_feature: GYAE6OF01D7ETL.24.53.E09.1.454.CMB.1.raw
  modified_base (162)..(162): a, c, t, g, unknown or other
  misc_feature (162)..(162): n is a, c, g, or t
  modified_base (296)..(296): a, c, t, g, unknown or other
  misc_feature (296)..(296): n is a, c, g, or t
  modified_base (470)..(498): a, c, t, g, unknown or other
  misc_feature (470)..(498): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacncgcccccaaactcctcatttatcgtaacaacaatcggccctcgtcggggtccctgaccgattcctccgcctccaagtctggccacctcagcctcgctggccatcactcgggctccgaggctgaggatggaggtnattactactgcctaggtcgtacgaagtagttggttccgggcgggaggtactaaggcgtcggaccgttcctaggtcacgccccgaaggcctcgccccctggtccactctcgtccccaccctccacactatacgtacgtctggagcgggtactcggacgaacggccgacgagtagnnnnnnnnnnnnnnnnnnnnnnnnnnnnn

SEQ ID NO: 264073 - DNA, 285 bp, Homo sapiens
  misc_feature: GYAE6OF01DMISZ.24.53.E09.1.454.CMB.1.raw
  modified_base (279)..(285): a, c, t, g, unknown or other
  misc_feature (279)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctcgttcccgccctcctcacatagtagtctgagcgggctggcaaggcgcatagnnnnnnn

SEQ ID NO: 264074 - DNA, 443 bp, Homo sapiens
  misc_feature: GYAE6OF01BMPUF.24.53.E09.1.454.CMB.1.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (422)..(443): a, c, t, g, unknown or other
  misc_feature (422)..(443): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctcaagtctggcacctcagcctcgctggccatcactggctccaggctgaggatggaggtnattactactgccagtcgtcgaagntgttcggcggaggactaagctgaccgtctaggtcagccaaggctcgcccctggtcactctcgtcccgcctctcacatacgtagtctgacgcggctggacaggcncatgncnnnnnnnnnnnnnnnnnnnnnn

SEQ ID NO: 264075 - DNA, 650 bp, Homo sapiens
  misc_feature: GYAE6OF01DBG0V.24.53.E09.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (621)..(622): a, c, t, g, unknown or other
  misc_feature (621)..(622): n is a, c, g, or t
  modified_base (627)..(630): a, c, t, g, unknown or other
  misc_feature (627)..(630): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (640)..(642): a, c, t, g, unknown or other
  misc_feature (640)..(642): n is a, c, g, or t
  modified_base (645)..(648): a, c, t, g, unknown or other
  misc_feature (645)..(648): n is a, c, g, or t
  modified_base (650)..(650): a, c, t, g, unknown or other
  misc_feature (650)..(650): n is a, c, g, or t
tcagactactatgtcacgaccggtgctcgatttagagagagtgtgttgggtttgggggctgtttttggagctgcttgtaccagaggtcaccatctcctgcactgggagcaacatcggcgcaggttttgatgtccactggacaagcagcttaccaaaaacngacccccaaatcctanattttanacgtaaacaacaagtcggccctcgtcggggtccctagaccgtattcnccgcctaccaagtctggacacctnagcctcgctggccatcactgggctaccgaggctggagtataggaggtanattacactcgcctaagtcgtacggaagtacgtggttaccggggagggaacgggtaaccttaaaggccgttaccggaacccggttccgttaacggggtactaaccggacccccgtaaaggtcccgttcccggtacccccccgtttacgggttaccaacccgtttcccgtttaccggtttaccccccgaccccctttacctaaccgaactacgtttaacggtaacgtttccgtaacgggtacggacccggggtacgttacgggaaccgaaacgggccgttaccgaagttacggcagtacagananagananangcncgannatgannnncgngnagnannncannnngn

SEQ ID NO: 264076 - DNA, 291 bp, Homo sapiens
  misc_feature: GYAE6OF01CD4C2.24.53.E09.1.454.CMB.1.raw
  modified_base (283)..(291): a, c, t, g, unknown or other
  misc_feature (283)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctcggtcactctgttccccaccctcctcacatagtagtctgagcgggctggcaaggcgcaatagnnnnnnnnn

SEQ ID NO: 264077 - DNA, 342 bp, Homo sapiens
  misc_feature: GYAE6OF01EJX7I.24.53.E09.1.454.CMB.1.raw
  modified_base (322)..(342): a, c, t, g, unknown or other
  misc_feature (322)..(342): n is a, c, g, or t
tcagactactatgtcacgaccggtgctcgatttagagagagtgtgttgggtttggggggtgtggtggtctccactcccgccttggacggggctgctatctgcctcgctggccatcactgggctccaggctgaggatggagggtgattactactgccagtcgtacgaagtatgttcgggcggagggaactaagctcgaccgtcctaggtcacgacccgaaggtcctccgcccccgttcggtccacgttccttcgtccccctacccctcctacactagtacgtagtcgtggacggcgggtcgtgggacgaaggccgacagtagnnnnnnnnnnnnnnnnnnnnn

SEQ ID NO: 264078 - DNA, 704 bp, Homo sapiens
  misc_feature: GYAE6OF01BTC0Z.24.53.E09.1.454.CMB.1.raw
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (672)..(672): a, c, t, g, unknown or other
  misc_feature (672)..(672): n is a, c, g, or t
  modified_base (674)..(677): a, c, t, g, unknown or other
  misc_feature (674)..(677): n is a, c, g, or t
  modified_base (679)..(695): a, c, t, g, unknown or other
  misc_feature (679)..(695): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
  modified_base (701)..(704): a, c, t, g, unknown or other
  misc_feature (701)..(704): n is a, c, g, or t
tcagactactatgtcacgaccggtgctcgatttagagagagtgtgttggggtttgggggctgtttttggagctgcttgtaccagagggtcaccatctcctgcactgggagcaacatcggcgcaggttttgatgtccactggtacaagcagccttaccaaaaacacgaccccccaaactcctctattttatcgtaaacaacaatccggccctcgtggggtcccctgaccgtattcctccgcctaccaagtctggcaccctcacgccctcgctcggccatccacgtgggccctaccagggctaggaagggtagtggtaaggggtatactttaaccgtaccgtcggacccctaagggttccggttaaccggaaaggttacgttaccggggtttaccggggaccgggggtaaaggggtaaccttaaacggggtccgtttaacggtaaccccggttacccggttaacgggtacccgaaccggacccccgaaaggggtccccttacccggccccccgttaccgggttaccctaccgttcccgtttacccggttaccccccctaaccccttacccgttaccaacccgttaagtttacgggttacgtaccttaggggaacgggtccggggtagtaccggggaacgaaacgggtccacgtaacgtcgatcanctagntacnannnnannnnnnnnnnnnnnnnnananannnn

SEQ ID NO: 264079 - DNA, 707 bp, Homo sapiens
  misc_feature: GYAE6OF01CMFC4.24.53.E09.1.454.CMB.1.raw
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagactactatgtcacgaccggtgctcgatttagagagagtgtgttgggtttgggaggcttggtccagcctggggggtccctgagactctcctgtgcagcctctggacttcccctttagtgtactttttggatgaccgtgggtccgccaggcctccgaggggacggggctgggaggtgggtcggaccaaatagtaaggcacgatggacgtagcatgtactagtgtggactgtgtggaacgggccattcaccatcctacgagacgacaaccgaccagaacctcacgtgtatcgtaaggaaatcgaaccagcgtagagaggtcgaacggacacggtctagtagttattcgtgtcgaccgtacattacncgacnccgtacgtggacgtccataacgtctaacgtaaacttccgtacgacgtacgtagggtccggggacccgacgggtcccttaccgtcggtacccgtaccgtcctccgtacgaccgtaccctacccggaacccgtacccgggaccccttaccggttcccggtttccccgtccccggtcggccctcccgtccgacccgtaccggacggaccgacccgtaccgtacgacgaccgaccgaccgaccgggtccggacccggtacggtccgtccggtccggttacggaaccgtaacggtacccttaccttaccgaacgttagttaacggtacgttcggtacggg

SEQ ID NO: 264080 - DNA, 458 bp, Homo sapiens
  misc_feature: GYAE6OF01E3NKW.24.53.E09.1.454.CMB.1.raw
  modified_base (293)..(293): a, c, t, g, unknown or other
  misc_feature (293)..(293): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
  modified_base (442)..(458): a, c, t, g, unknown or other
  misc_feature (442)..(458): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctcccaggctgaggatggagggtnattactactcgccagtcgtcgaagatggttcggcggagggtactaagctacgaccgtcctaggtcacgcccaaggcctcgccccgtcggtccnctcttcgtccccgccctctcacatagtntcgtgngcggctggcgaggcncatacgnnnnnnnnnnnnnnnnn

SEQ ID NO: 264081 - DNA, 623 bp, Homo sapiens
  misc_feature: GYAE6OF01C6TK7.24.53.E09.1.454.CMB.1.raw
  modified_base (170)..(170): a, c, t, g, unknown or other
  misc_feature (170)..(170): n is a, c, g, or t
  modified_base (318)..(318): a, c, t, g, unknown or other
  misc_feature (318)..(318): n is a, c, g, or t
  modified_base (551)..(551): a, c, t, g, unknown or other
  misc_feature (551)..(551): n is a, c, g, or t
  modified_base (561)..(561): a, c, t, g, unknown or other
  misc_feature (561)..(561): n is a, c, g, or t
  modified_base (617)..(617): a, c, t, g, unknown or other
  misc_feature (617)..(617): n is a, c, g, or t
tcagactactatgtcacgaccggtgctcgatttagagagagtgtgttggggtttaggggggctgttttggaagctgcttgtaccagagggtcaccatctctgcacgtggagcaacactcggccgccacggttttgatgtccgactggtacaagcgagcttccaaaaaacncgcccccaaaactcctcattttactcggtaacaacgaactccggcctctggggtccctgaccgactctccgcctcaagtcctggccacctcagcctcgctaggaccatcacgtgggcctaccaaggactcgaggatacggaacggtanattaactacgttgtccgaagttcgacgtaaaggcgtacgttcgggacgggagggactaaaggccgtgaacccggttctaagggtccacgtacccgtaaagggctcggaccccctaggtcccaccttcgtaccggtttccccacccgttccgtaccaactacgttaacggtacgtcgtacggaggcgggcttagggacgtaaaggccgtcaagtacggatcatgacgatcgaanagtagagtgngagacgacgtagtacgtacgacgtagacgacgacgacgcgcgcgcgtcactactcnctctcg

SEQ ID NO: 264082 - DNA, 301 bp, Homo sapiens
  misc_feature: GYAE6OF01DLKWG.24.53.E09.1.454.CMB.1.raw
  modified_base (287)..(301): a, c, t, g, unknown or other
  misc_feature (287)..(301): n is a, c, g, or t
tcagactactatgtcacgaccggtgctcgatttagagagagtgtgttgggtttgggggtgtggtggtctccactcccgcttgacgggctgctatctgcctcgctggccatcactgggctccaggctgaggatgagggtgattactactgccagtcgtcgaagatgttcggcggaggactaagctgaccgtcctaggtcacgcccaaggcctcgccccctggtcactcctcgtccccaccctcctcactatagtagtctgaggcgggctggccaaaggcgacagtagnnnnnnnnnnnnnnn

SEQ ID NO: 264083 - DNA, 320 bp, Homo sapiens
  misc_feature: GYAE6OF01A0QA0.24.53.E09.1.454.CMB.1.raw
  modified_base (142)..(142): a, c, t, g, unknown or other
  misc_feature (142)..(142): n is a, c, g, or t
  modified_base (291)..(320): a, c, t, g, unknown or other
  misc_feature (291)..(320): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtnattactactgccagtcgtcgaagatgttcggcggagggactaagctgaccgtctaggtcagcccaaggctcgcccctggtcactctcgttccccacctcctacactatagtacgtctggagacggggctaggctaagggcgctaatagnnnnnnnnnnnnnnnnnnnnnnnnnnnnnn

SEQ ID NO: 264084 - DNA, 710 bp, Homo sapiens
  misc_feature: GYAE6OF01DXRLA.24.53.E09.1.454.CMB.1.raw
  modified_base (676)..(676): a, c, t, g, unknown or other
  misc_feature (676)..(676): n is a, c, g, or t
  modified_base (681)..(687): a, c, t, g, unknown or other
  misc_feature (681)..(687): n is a, c, g, or t
  modified_base (689)..(695): a, c, t, g, unknown or other
  misc_feature (689)..(695): n is a, c, g, or t
  modified_base (697)..(710): a, c, t, g, unknown or other
  misc_feature (697)..(710): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccatggtacaagcagcttaccaaaaacacgaccccccaaactcctactattttaactacgtaaacaacaatccggtccctcgtcggggtcccctaggacccgtactttcccgtccccgccctaccaaacgtccgtacggacccaccctcgaccgccctccggacctcggaccctatccgacgttcgggcctaccgaagggtcctagggacggtagtaggggaagggttacgtaacttttaccgaaccttcggacccgtacggttccggtacggaaaaggtcgtttacggggttcggggacggggtaagggtaaacgtaacggccgttaccggtaacccccgggtttaccgtacgggtaccgaaccggacccccggtaaacggttcccgtccccccggtccccccgtttacgggttacccctacccgtttccccgtttcccccgttcccccccgcccccttaacccttaccgaacttaacgtttaggtaccgtcgtacgggacgggccgggtacggtccggaacgcggaccgcgtaagtacggnagcannnnnnntnnnnnnngnnnnnnnnnnnnnn

SEQ ID NO: 264085 - DNA, 307 bp, Homo sapiens
  misc_feature: GYAE6OF01EWLNA.24.53.E09.1.454.CMB.1.raw
  modified_base (287)..(307): a, c, t, g, unknown or other
  misc_feature (287)..(307): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcacgcccaaggctcgccccctcggtcactctcgttccccaccctcctcacatagtagtctgagcggcgtggacgacggcgacatgnnnnnnnnnnnnnnnnnnnnn

SEQ ID NO: 264086 - DNA, 731 bp, Homo sapiens
  misc_feature: GYAE6OF01AIBFM.24.53.E09.1.454.CMB.1.raw
  modified_base (163)..(163): a, c, t, g, unknown or other
  misc_feature (163)..(163): n is a, c, g, or t
  modified_base (669)..(669): a, c, t, g, unknown or other
  misc_feature (669)..(669): n is a, c, g, or t
  modified_base (675)..(675): a, c, t, g, unknown or other
  misc_feature (675)..(675): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (699)..(699): a, c, t, g, unknown or other
  misc_feature (699)..(699): n is a, c, g, or t
  modified_base (701)..(701): a, c, t, g, unknown or other
  misc_feature (701)..(701): n is a, c, g, or t
  modified_base (704)..(704): a, c, t, g, unknown or other
  misc_feature (704)..(704): n is a, c, g, or t
  modified_base (707)..(707): a, c, t, g, unknown or other
  misc_feature (707)..(707): n is a, c, g, or t
  modified_base (709)..(710): a, c, t, g, unknown or other
  misc_feature (709)..(710): n is a, c, g, or t
  modified_base (712)..(712): a, c, t, g, unknown or other
  misc_feature (712)..(712): n is a, c, g, or t
  modified_base (714)..(715): a, c, t, g, unknown or other
  misc_feature (714)..(715): n is a, c, g, or t
  modified_base (717)..(717): a, c, t, g, unknown or other
  misc_feature (717)..(717): n is a, c, g, or t
  modified_base (719)..(721): a, c, t, g, unknown or other
  misc_feature (719)..(721): n is a, c, g, or t
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
  modified_base (727)..(731): a, c, t, g, unknown or other
  misc_feature (727)..(731): n is a, c, g, or t
tcagactactatgtcacgaccggtgctcgatttagagagagtgtgttgggtttgggggctgttttggagctgcttgtaccagagggtcaccatctcctgcactgggagcaacatcggcgctaggttttgatgtccactggtacaagcagccttaccaaaaacncgacccccaaactcctctattttatacgtaaacaacaactccggcccttcgtcggggtccctgaccgtattcctccgcctccaagtctcggccacctcacgcctcgctcggccatcacgtcggggcctccgacgggtcctagggagggtacgtgggaacggggttgtaactttaacctccgtacggtacccgtaggttccgtacggtaacgttaggttccgggtttacggggaccggggtaacggggtaaccttaacggccgttaccggtaccccggttaccggttacgggtaccgaaccggccccgtaaacgggtcccgttaccccggtaccccccgtttcgggttaccctaccgtttccccgggtttaccccggtttccccccgtacccccttacccgtaccgtaaccgttaacgtttaacgggttacgttaccggtacgggtaccgggtccggggtacggttaacgggaccggtaacggggccgtaaccgtaggtaacggacngctacngtcgcgtncncgcgtcgctacgcncncgngcncnncncnncncnnncncncnnnnn

SEQ ID NO: 264087 - DNA, 324 bp, Homo sapiens
  misc_feature: GYAE6OF01BHUMY.24.53.E09.1.454.CMB.1.raw
  modified_base (238)..(238): a, c, t, g, unknown or other
  misc_feature (238)..(238): n is a, c, g, or t
  modified_base (304)..(324): a, c, t, g, unknown or other
  misc_feature (304)..(324): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtacgaagatgttcggcggagggactaagctgaccgtctaggtcagcccgaaggctccgcccctggtcacttctgttccnccacccttcctacactagtagtcgtccgtggcggccgggtctagggccgaaacgggcgacagtagnnnnnnnnnnnnnnnnnnnnn

SEQ ID NO: 264088 - DNA, 283 bp, Homo sapiens
  misc_feature: GYAE6OF01B5V02.24.53.E09.1.454.CMB.1.raw
  modified_base (271)..(271): a, c, t, g, unknown or other
  misc_feature (271)..(271): n is a, c, g, or t
  modified_base (277)..(283): a, c, t, g, unknown or other
  misc_feature (277)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggtgattactactgccagtcgtcgaagatgttcggcggagggactaagctgaccgtctaggtcagcccaaggctgccccctggtcactctcgttcccacctcctcacatagtagtctgagcgggctggcaaggcncatagnnnnnnn

SEQ ID NO: 264089 - DNA, 691 bp, Homo sapiens
  misc_feature: GYAE6OF01B9T9H.24.53.E09.1.454.CMB.1.raw
  modified_base (307)..(307): a, c, t, g, unknown or other
  misc_feature (307)..(307): n is a, c, g, or t
  modified_base (612)..(612): a, c, t, g, unknown or other
  misc_feature (612)..(612): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (685)..(685): a, c, t, g, unknown or other
  misc_feature (685)..(685): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgcaggttttgatgtcactggtacaagcagcttaccaaaaacacgacccccaaaactcctcatttatcgtaaacaacaatccggccctcgtcggggtcccctgacccgtattctcccgcctccaagtctggcacctcacgcctcgctcggccatcacgtgggctccgaggctggaggatggaggggtnatttactactgaccgagtcgtacgaagattcggttacggggcggaacgggtaacttaacgcgttacggaacccgttcccgtagggtccaacggtacccccgaaaggggtccccttaccggccccccccgtttcgggtaccctaccctttaccccgggtttcccgttttaaccccccgacccccccttttacccgaccctaaacgtaacggtttaacggttaacggttccggttacgggaaccgggttccgggggcgttcggggaacccggaaaaccggggtcccggtaaccgtaaagttaccggngtctactcgcgtacgtgtagctgntcncncgngacgancncgtacagtgtcgagcncncncgcgacacacgcngcgtcg

SEQ ID NO: 264090 - DNA, 996 bp, Homo sapiens
  misc_feature: GYAE6OF01AP40S.24.53.E09.1.454.CMB.1.raw
  modified_base (245)..(245): a, c, t, g, unknown or other
  misc_feature (245)..(245): n is a, c, g, or t
tcagactactatgtcacgaccggtgctcgatttagagagagtgtgttgggtttgggaggcttggtccagcctggggggtccctgagactctcctgtgcagcctctggacttcccctttagtgtactttttggatgacctgggtccgccaggctccgaggggacgggctggagtgggtggccaatataaggcacgatggacgtagcatgtactatgtggactctgtggaagggccattcaccatcnccagacgacaacgccagaactcactgtatcgtaggaactcgaccagcctaggacggtacgtcggaacggacgacggtactacgtggttaatttacgtggtacgtaccggtaaacctaagttaactacccgaacggtaccctaaccccggttaggggaaccggttccgaaccgttaaacgtttaccccgttaaaggtaaaacccttttaaccccgttttacccggaaacggggtaccggtttaaccggggttttaccgggggggaacccccgtaaacgggggggttaccccttaaaccccccggggttttcccggggttaaccccgttaacccccgggtttcccttaacccccggtttacccgtaaccccggttacccccgtttaaccccggaaaacccccgggaaacccgggggtaccccccgtaacccgggttttacccccggggtttcccccggttttacccccccccgggttccgggggtccccccggttacccccggttaccgggtccccccggtttaaccccgggaaccggggtaccccggtaacccccgtaacccccgggttaaccgggtaaccgggaacccggtacccgaacccgggtaacccgggtccccggggtccccggtccgggggtacccgttcccgggtaacccggttacggggttaacccggtaaacccgggttaccctttaacccgttaaacccgtaacgttaacgttaacggttaccggttacgggtaaccgggg

SEQ ID NO: 264091 - DNA, 288 bp, Homo sapiens
  misc_feature: GYAE6OF01AVLCQ.24.53.E09.1.454.CMB.1.raw
  modified_base (282)..(288): a, c, t, g, unknown or other
  misc_feature (282)..(288): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatggagggtgattactactgccagtcgtacgaagatgttcggcggagggactaagctgaccgtcctaggtcagcccaaggctcgcccctcggtcactctcgttccccacctcctcacatagtagtctggagcgggctggcaaggcgcatgnnnnnnn

SEQ ID NO: 264092 - DNA, 288 bp, Homo sapiens
  misc_feature: GYAE6OF01BWI5R.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggttgggggtgtggtggtctccactcccgccttgacggggctgctatctgcctcgctggccatcactgggctccaggctgaggatgagggtgattactactgccagtcgtcgaagatgttcggcggagggactaagctcgaccgtcctaggtcagcccaaggctcgcccctggtcactctcgttcccgccctcctcacatagtagtcgtgagcggctggcaaggcgcatagnnnnnnnnn

SEQ ID NO: 264093 - DNA, 766 bp, Homo sapiens
  misc_feature: GYAE6OF01CNJF0.24.53.E09.1.454.CMB.1.raw
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
  modified_base (625)..(625): a, c, t, g, unknown or other
  misc_feature (625)..(625): n is a, c, g, or t
  modified_base (679)..(679): a, c, t, g, unknown or other
  misc_feature (679)..(679): n is a, c, g, or t
  modified_base (690)..(690): a, c, t, g, unknown or other
  misc_feature (690)..(690): n is a, c, g, or t
tcagactactatgtcacgaccggtgctcgatttagagagagtgtggttgggtttggggaggcttggtccagccgtgggggggtccctgagactctcctgtgcagcctctggactttcccctttagtgtacttttggatcgaccgtgggccgccaggctaccggaggggacggggctgggaggtggggtcggaccaaatagtaaggcaacgagtgggaacgtagctagttacgtaactagtggtacgggactcggtaggtaggaacggggtcctaattccacaattccaccgaaggacaaccgaaaccggacccaaggaacctcgtaacgttacgtaactaccggtaaggaaaactcgaacccacggtacgtaggacggtacggtacggaaccggtaacgacggttataaggttcttaacgttacgtacggtacgaccaacttagttaacncgaacgaccgtaacggnggtacgtacgacctaaggtaccctagttaaacctaccttacgacgggttactacgggggttaccggggacgacgggtaccctcccggtcggtacctccgttcctcgacctaccgccctacccgaaaccggacggtcccgtaccttcccgggttccccncccggtaccgtcccgtcgacccgtcggtaccgaccggcctacccgctaaccggnaccgcgaccgnggccgtcggtcgcgacgggtcacgggtcctaaacggtccttaccgtaccgaatacggttaacgtcggtacggtcgg

SEQ ID NO: 264094 - DNA, 591 bp, Homo sapiens
  misc_feature: GYAE6OF01EBZII.24.53.E09.1.454.CMB.1.raw
  modified_base (163)..(163): a, c, t, g, unknown or other
  misc_feature (163)..(163): n is a, c, g, or t
  modified_base (231)..(231): a, c, t, g, unknown or other
  misc_feature (231)..(231): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (559)..(560): a, c, t, g, unknown or other
  misc_feature (559)..(560): n is a, c, g, or t
  modified_base (562)..(591): a, c, t, g, unknown or other
  misc_feature (562)..(591): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgccccccaaactcctcattttatacgtaacaacaatccggccctcgtggggtccctgaccgtattcncccgtcctccaagtctggcaccctcacgcctcgctggcccatccacgtcgggcctccgaggctggaggattggagggttgaatttacgtactcgccaggttcggtacggaaagtagttcggttcggggacgggtagggtaacctaagccgtacgtaacccgttccgttacggcaccggacccgaaaggcccgttccccgcccccgttgggtccctaaccgttcctttacccgttccccccaccccttcctaccgaacttacgtacgtcgtacgtggacggtccggggtcgtaccgggacgacgggaccgtacaagttaggcngnacgnngnnnnnnnnnnnnnnnnnnnnnnnnnnnnnn

SEQ ID NO: 264095 - DNA, 647 bp, Homo sapiens
  misc_feature: GYAE6OF01D4M9Y.24.53.E09.1.454.CMB.1.raw
  modified_base (273)..(273): a, c, t, g, unknown or other
  misc_feature (273)..(273): n is a, c, g, or t
  modified_base (536)..(536): a, c, t, g, unknown or other
  misc_feature (536)..(536): n is a, c, g, or t
  modified_base (613)..(618): a, c, t, g, unknown or other
  misc_feature (613)..(618): n is a, c, g, or t
  modified_base (620)..(632): a, c, t, g, unknown or other
  misc_feature (620)..(632): n is a, c, g, or t
  modified_base (634)..(647): a, c, t, g, unknown or other
  misc_feature (634)..(647): n is a, c, g, or t
tcagactactatgtcacgaccggtgctcgatttagagagagtgtgttgggtttgggggcttgtttttggaagctgcttgtaccagagggtcaccatctcctgcacgtgggagcaacagtcggcgctaggttttgatcgtccactggtacaagcagaccttaaccaaaaacacgacccccaaactcctctatttactacgtaaacaacacgtccggccctcggtcgggtcctcgtaccgtacttccgtcccgcctaccgaacgtcgtcgacccncctacgcgtccgtccgtcgtccggacctactaccgtcgtcggtccgtacccgaggtcgtaggaggtagtagggtaggttacgtaacttactacgtcgtacgtacgtacggtacgaacgtagttcgggtacgggacgggtaacggaacgtaaccgtcgtaccggtaccgtaccgtacggtaccgaccgtaccggaccggtccgtccccgtcccgtccgtaccgtaccttccgttcccgttaccccctaccctacctaccgtaanccccgttaaggtcctagggtaccgtcggggacctacgggggccttaacggggcctaacggacgttacggctgacgtnnnnnncnnnnnnnnnnnnngnnnnnnnnnnnnnn

SEQ ID NO: 264096 - DNA, 324 bp, Homo sapiens
  misc_feature: GYAE6OF01CKWLL.24.53.E09.1.454.CMB.1.raw
  modified_base (310)..(324): a, c, t, g, unknown or other
  misc_feature (310)..(324): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtacgaagatggttcggcggagggactaagctgaccgtcctaggtcacgcccgaaggcctcgcccccgtcggtcaccttctcgttccccaccctcctacacattacgtagtcgtggacggtcggggctgggacgaaaggcgtacaataggcnnnnnnnnnnnnnnn

SEQ ID NO: 264097 - DNA, 590 bp, Homo sapiens
  misc_feature: GYAE6OF01D8HLB.24.53.E09.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (557)..(590): a, c, t, g, unknown or other
  misc_feature (557)..(590): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgccccccaaatccctnattttancgtaacaacaatccggccctcgtcggggtcccctgaccgatttccncccgcctccaagtctggccacctcacgcctcggctggccatcacgtgggctccaggctgaggatggaggtgattacgtactgcctaggtcgtacggaagtagtcgggttccggacgggaacgggaactaagcgtcggaacccgttcgtaggtccgacgaccccgaaagggccctacccgtccccccgtacgggtaccacccgttccttccggtttacccccccaaccccttccccttacaaacccgtagttaaccggttaacgtccgttaggacggggtcccgggcgttaccgggaacgtaaacgggccgtaccgaatacgcgtnnnnnnnnnnnnnnnnnnnnnnnnnnnnnnnnnn

SEQ ID NO: 264098 - DNA, 761 bp, Homo sapiens
  misc_feature: GYAE6OF01DMK1J.24.53.E09.1.454.CMB.1.raw
  modified_base (725)..(725): a, c, t, g, unknown or other
  misc_feature (725)..(725): n is a, c, g, or t
  modified_base (730)..(732): a, c, t, g, unknown or other
  misc_feature (730)..(732): n is a, c, g, or t
  modified_base (734)..(736): a, c, t, g, unknown or other
  misc_feature (734)..(736): n is a, c, g, or t
  modified_base (738)..(761): a, c, t, g, unknown or other
  misc_feature (738)..(761): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgctaggttttgatgtccactggtacaagcagcttaccaaaaacacgacccccaaactcctatatttatacgtaaacaacaacgtccggcccttcgtcggggtccctggaccgtacttccgtcccgtcctccgaagtcgtcggccacctcgacgcctcgctcggaccagtccgacgtcgggcctccgaggcgtcggaaggtagtacgggtaaggggttctaagttaccgtacgtcggtacccgtacggttaccggtaacggtaaacggttacggtttcggggtttaaccggggacgggtaaacggggtaacctttaacgggtacccggttaccggtaaccccgggtttaccggttaacgggacccgtaacccggtaccccggtaaacgggtccccgttaccccgggtaacccccccgtttcgggtaacccccgttaacgtttcccccggtttaccccccggttttccccccggaaccccctttccgtaaacccttaacccggttaacggttaaccggtttaaccgttccgggttaccggggaaccggggtccgggggttaccgtacggggaaccgtaaccgggggtctaaccggaagttacggctncgcannngnnngnnnnnnnnnnnnnnnnnnnnnnnn

SEQ ID NO: 264099 - DNA, 436 bp, Homo sapiens
  misc_feature: GYAE6OF01C39KS.24.53.E09.1.454.CMB.1.raw
  modified_base (163)..(163): a, c, t, g, unknown or other
  misc_feature (163)..(163): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (428)..(436): a, c, t, g, unknown or other
  misc_feature (428)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaatcctcatttatcgtaacaacaatcggccctctggggtccctgaccgattcctccgcctccaagtctggccacctcagcctcgctggccatccacgtgggctccgaggcctgaggatgaggtgattactactgccagtcgtcgaagatggtcggcggaggactaagctgaccgtctaggtcagcccgaaggctcgcccctggtcactctcgttcccgcctctcacgntacgtgctgagcggntggacaggcnatgnnnnnnnnn

SEQ ID NO: 264100 - DNA, 331 bp, Homo sapiens
  misc_feature: GYAE6OF01DMOSY.24.53.E09.1.454.CMB.1.raw
  modified_base (168)..(168): a, c, t, g, unknown or other
  misc_feature (168)..(168): n is a, c, g, or t
  modified_base (305)..(331): a, c, t, g, unknown or other
  misc_feature (305)..(331): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgatttactactgccagttcgtcgaagntgttcggcggagggactaagctgaccgtctagtcacgccaggctccgcccctgtcacttctccgttccccacccttcctacactattagtacgttcgtggacggtccgggctagggaccgaaggccgactaatggcnnnnnnnnnnnnnnnnnnnnnnnnnnn

SEQ ID NO: 264101 - DNA, 316 bp, Homo sapiens
  misc_feature: GYAE6OF01EYQNV.24.53.E09.1.454.CMB.1.raw
  modified_base (295)..(316): a, c, t, g, unknown or other
  misc_feature (295)..(316): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtacgaagatggttcggcggagggactaagctgaccgtctaggtcacgcccaaggctcgccccctcggtcactctcgttccccgccctcctcacatagtagtctggacggcgggcgtggacgaaggcgacaatagnnnnnnnnnnnnnnnnnnnnnn

SEQ ID NO: 264102 - DNA, 526 bp, Homo sapiens
  misc_feature: GYAE6OF01ALQ09.24.53.E09.1.454.CMB.1.raw
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
  modified_base (501)..(501): a, c, t, g, unknown or other
  misc_feature (501)..(501): n is a, c, g, or t
  modified_base (503)..(526): a, c, t, g, unknown or other
  misc_feature (503)..(526): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgccccccaaactcctcattttatcgtaacaacaatcggccctntggggtccctgaccgattcctccgcctccaagtctggccacctcncgcctcgctcggccatcacgtgggcctccgaggctagaggatggagggtgatttacactcgccagtcgtacgaagtagttggttccgggacggagggactagcgtacgaccgtccgtaggtccacgaccctaaggcctcccggtccccctcggtctaccttcccgtccgttcccccgacccctctaccaactacttagttacgcgttggacggtccgggcgtcgggaccgaacggccgactaagtcgangnnnnnnnnnnnnnnnnnnnnnnnn

SEQ ID NO: 264103 - DNA, 683 bp, Homo sapiens
  misc_feature: GYAE6OF01BSGGW.24.53.E09.1.454.CMB.1.raw
  modified_base (335)..(335): a, c, t, g, unknown or other
  misc_feature (335)..(335): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (644)..(646): a, c, t, g, unknown or other
  misc_feature (644)..(646): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
  modified_base (662)..(663): a, c, t, g, unknown or other
  misc_feature (662)..(663): n is a, c, g, or t
  modified_base (665)..(674): a, c, t, g, unknown or other
  misc_feature (665)..(674): n is a, c, g, or t
  modified_base (676)..(676): a, c, t, g, unknown or other
  misc_feature (676)..(676): n is a, c, g, or t
  modified_base (678)..(681): a, c, t, g, unknown or other
  misc_feature (678)..(681): n is a, c, g, or t
  modified_base (683)..(683): a, c, t, g, unknown or other
  misc_feature (683)..(683): n is a, c, g, or t
tcagactactatgtcacgaccggtgctcgatttagagagagtgtgttgggtttggggctgttttggagctgcttgtaccagagggtcaccatctcctgcactgggagcaaacatcggcgcgtaggttttgatgtccactggtacaagcagcttaccaaaaacacgacccccaaactcctcatttactacgtaaacaaacaatccggcccttcgtgggtccctcgaccgatttcctccgccttaccaagtcgttacggccacctcacgccctcgctacggacccattccacgtcggggaccttcccagggcgtaggagggtatcggggtaggggtntacgtttaactaccgttagacccgaggttacgtacgaaaggtacgtttcgggttacggggacgggaacggggtaaacctaaggtccgtcgggtaaccccgtcccgttaagggtccaacggtaccccgaaacgggtcctccccggaccccgttcggaccgaccttccgttacccgttacccccctaccccttccctacctaaccgtaacgtttacggtaacccggttttgtcgggggaacgggtcccggggggtacttacggggaacccggaaagggttccccggtaagaaagttaccggngngcnacannnancgngtcngncangnngnnnnnnnnnngncnnnngn

SEQ ID NO: 264104 - DNA, 311 bp, Homo sapiens
  misc_feature: GYAE6OF01A8HYH.24.53.E09.1.454.CMB.1.raw
  modified_base (295)..(311): a, c, t, g, unknown or other
  misc_feature (295)..(311): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagccaaggctcgcccctggtcactctcgttcccaccctcctcactatagtagtcgtggacggcgggtctcggacgaacgggccgactagtagnnnnnnnnnnnnnnnnn

SEQ ID NO: 264105 - DNA, 706 bp, Homo sapiens
  misc_feature: GYAE6OF01CE4PS.24.53.E09.1.454.CMB.1.raw
  modified_base (165)..(165): a, c, t, g, unknown or other
  misc_feature (165)..(165): n is a, c, g, or t
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
  modified_base (354)..(354): a, c, t, g, unknown or other
  misc_feature (354)..(354): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
  modified_base (661)..(661): a, c, t, g, unknown or other
  misc_feature (661)..(661): n is a, c, g, or t
  modified_base (664)..(665): a, c, t, g, unknown or other
  misc_feature (664)..(665): n is a, c, g, or t
  modified_base (671)..(671): a, c, t, g, unknown or other
  misc_feature (671)..(671): n is a, c, g, or t
  modified_base (673)..(674): a, c, t, g, unknown or other
  misc_feature (673)..(674): n is a, c, g, or t
  modified_base (677)..(677): a, c, t, g, unknown or other
  misc_feature (677)..(677): n is a, c, g, or t
  modified_base (679)..(680): a, c, t, g, unknown or other
  misc_feature (679)..(680): n is a, c, g, or t
  modified_base (682)..(683): a, c, t, g, unknown or other
  misc_feature (682)..(683): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(695): a, c, t, g, unknown or other
  misc_feature (690)..(695): n is a, c, g, or t
  modified_base (700)..(701): a, c, t, g, unknown or other
  misc_feature (700)..(701): n is a, c, g, or t
  modified_base (704)..(705): a, c, t, g, unknown or other
  misc_feature (704)..(705): n is a, c, g, or t
tcagactactatgtcacgaccggtgctcgatttagagagagtgtgttggggtttgggggctgtttttggaagctgcttgtaccagagggtcaccatctcctgcactggggagcaacatcggcgcaggttttgatgtccactggtacaagcagcttaccaaaaacncgacccccaaatcctcatttanacgtaaacaacaactccggccctcgtacgggggtcccctagaccgactttccncccggtcccttacccaaggtccgtacggacccaaccctacacgtccctacggctagggccctataccgacgttcggggcctaccgaggcctagaagggaagttggaaggggttntaactttaaccgactcggaccgaggttaccgtacggaaagtagtcggttacggggacgggaagggaacttaacggccgtacggtaaccccggtacgttaacggacccaacgggtaccccctaaaggggtcccctacccgtacccccccggtttgggttacccaaccccgttttacccgttaccccgggtttaccccccgcccccttaacccttacgaacggttaaacgttaacggttaacgtccgtagggaacgggccggggtactacgggaacgtaacggccgaacgtagtaggntacngagnganagnngagtananncananngnntanancnnnnnngtcannacnna

SEQ ID NO: 264106 - DNA, 805 bp, Homo sapiens
  misc_feature: GYAE6OF01AJ7KB.24.53.E09.1.454.CMB.1.raw
  modified_base (159)..(159): a, c, t, g, unknown or other
  misc_feature (159)..(159): n is a, c, g, or t
  modified_base (301)..(301): a, c, t, g, unknown or other
  misc_feature (301)..(301): n is a, c, g, or t
  modified_base (788)..(788): a, c, t, g, unknown or other
  misc_feature (788)..(788): n is a, c, g, or t
  modified_base (793)..(793): a, c, t, g, unknown or other
  misc_feature (793)..(793): n is a, c, g, or t
  modified_base (804)..(804): a, c, t, g, unknown or other
  misc_feature (804)..(804): n is a, c, g, or t
tcagactactatgtcacgaccggtgctcgatttagagagagtgtgttgggtttggggctgttttggagctgcttgtaccagagggtcaccatctcctgcactgggagcaacatcggcgcaggttttgatgtccactggtacagcagcttaccaaaaacncgcccccaaactcctctatttatcgtaaacaacaatccggccctgtcgggtccctgaccgtacttccgccgcctacctaagtctggccacctcacgcctcgtctcggccatccacgttcggcctccgaggtctaggaaggtntacgggtaggtagaacttttacctaacttcggacccgtacggttaccgtaccggtaaagtcggttaccgggtttccgggggaccgggtaacgggttaacccgtaaacggtccgtttaccggtaaccccgttacccgtttaccgggtaaccgtaaccccggacccgggtaaaccgggtccccgttaccccgggtaccccccggttttcgggtacccctttaacccgttccccgggttttcccccggtttaaccccccggtcccccgtttaccctaaccgtaaccgttaacggtttaaccggttttaacggttcccgttacggggaaccgggtttcccgggggaccttaacggggtaccggaaaccggttcccggggaaccctaaacggttagggcccacgtacggttagtaccgtctcgtacgtacgtacgtcgtacgacgtacgtcgtacgacgcgtcgacgtacgcgtcgtacgtcgctacgtacncgtcncgtcacgtgcng

SEQ ID NO: 264107 - DNA, 629 bp, Homo sapiens
  misc_feature: GYAE6OF01BZPNO.24.53.E09.1.454.CMB.1.raw
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (598)..(629): a, c, t, g, unknown or other
  misc_feature (598)..(629): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacacgaccccccaaactcctctattttatccgtaaacaacaagtccggccctcgtcggggtccctcgaccgtattcctcccgcctccaagtctggcacctcacgccccgctcggccatcacgtgggctccgacggctacggaggtactggaggggtgtaattacctaccgtcggcctacggtcggtaccgaagtagtttcggttacgggacggggtaagggaacttaaggcccgttcgaccccggttccgttacgggtaccaccggtaacccgaacgggtccctcccggtcccccccgttggtaccctaccgtttccgttcccgttcccccctaccccgtcccctacctactaacgttacggttaacgtccgttaggacggggtccgggtaccgttcgggaaccggtaacgggccgtataacgtaggcngtcntacnnnnnnnnnnnnnnnnnnnnnnnnnnnnnnnn

SEQ ID NO: 264108 - DNA, 295 bp, Homo sapiens
  misc_feature: GYAE6OF01D3QTE.24.53.E09.1.454.CMB.1.raw
  modified_base (211)..(211): a, c, t, g, unknown or other
  misc_feature (211)..(211): n is a, c, g, or t
  modified_base (280)..(295): a, c, t, g, unknown or other
  misc_feature (280)..(295): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagccaaggcncgcccctgcactctcgtcccacctcctcactatgtagtctgaggcggctggacgtaaggccgacatagnnnnnnnnnnnnnnnn

SEQ ID NO: 264109 - DNA, 558 bp, Homo sapiens
  misc_feature: GYAE6OF01DCMFS.24.53.E09.1.454.CMB.1.raw
  modified_base (238)..(238): a, c, t, g, unknown or other
  misc_feature (238)..(238): n is a, c, g, or t
  modified_base (529)..(558): a, c, t, g, unknown or other
  misc_feature (529)..(558): n is a, c, g, or t
tcagactactatgtcacgaccggtgctcgatttagagagagtgtgttgggttgggggctgttttggaagctgcttgtaccagagggtcaccatctcctgcacgtgggagcaacatcggcgctaggttttgatgtccactggtacaagcagccttaaccaaaaaacacgaccccccaaactcctactatttatacgtaacaacaatccggcccgtcgtcggggtccctgaccgtatccncccgcctaccaagtcgtgccacctcacgcctgctcgccatcacgtggcctaccggaggctggaggtatggaggtacgtattactcgtcgaccgtacgtcgtacgaaagtgtacgggtcgggacgggtaaggaacttacggcgtaccgtaccgtcgtaggccacggacccgacggcctacccggccccgttaggtcctaccttccgtccgttccccaccctctaacacgtagtacgttacgtcgtaggacggtacggcgtaggaaccgtaacgggtccaactagagctagcnnnnnnnnnnnnnnnnnnnnnnnnnnnnnn

SEQ ID NO: 264110 - DNA, 558 bp, Homo sapiens
  misc_feature: GYAE6OF01ARA4O.24.53.E09.1.454.CMB.1.raw
  modified_base (153)..(153): a, c, t, g, unknown or other
  misc_feature (153)..(153): n is a, c, g, or t
  modified_base (177)..(177): a, c, t, g, unknown or other
  misc_feature (177)..(177): n is a, c, g, or t
  modified_base (305)..(305): a, c, t, g, unknown or other
  misc_feature (305)..(305): n is a, c, g, or t
  modified_base (307)..(308): a, c, t, g, unknown or other
  misc_feature (307)..(308): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (501)..(501): a, c, t, g, unknown or other
  misc_feature (501)..(501): n is a, c, g, or t
tcagactactatgtcacgaccggtgctcgatttagagagagtgtgttgggtttgggggtgtaggtggtctccactcccgccttagacgggctgcgtatctgcctcgctggccagtcactggctccaggctcgagatgacggtgattactaccngccagtcgtcgaagagtgttcggnggaggactaagctcgacccgtcgtaggtccacgcccgaaggcctcgacccccctcgtcactcctcgttccccgccctcctcgacatacggtagtcgtggacgccgggctaggacaacggctacagtgncnncgtacngcncgtncgactcncgtacatggctagccgcgacgttancgtancgactagctaacgctactcgatctgccgactcgacncgacngcgactacgacgacgacgacgcgtacgtagacgacgtagtacgacgacgtcgacgttagtacgttacgtacgtcgtacgtacgtcgtacgcacgtcgtacgngtacgtacgtacgtcgtgacgtcgacgtacgtacgtcgtaccgtacgcgcgtcgtcg

SEQ ID NO: 264111 - DNA, 703 bp, Homo sapiens
  misc_feature: GYAE6OF01D18C5.24.53.E09.1.454.CMB.1.raw
  modified_base (349)..(349): a, c, t, g, unknown or other
  misc_feature (349)..(349): n is a, c, g, or t
tcagactactatgtcacgaccggtgctcgatttagagagagtgtgttgggtttggggaggcttggtccagcctggggggtccctgagactctcctgtgcagcctctggattcccctttagtgtactttttggatgacctgggtccgccaggctccgaggggacgggctggagtgggtggccaaatataaggcacgatggacgtagcatgtactatgtggactctgtagaaggccgattccaccatcctccaagacgacaacgcccagaacctcactgtatcgtagaaatcgacagcctgagagtcggaggacacggctatgtattactgtgcgacatatcagctaccgnggacgtcgacatctagtaacttacctaccgagtctaaggttcggggaccctacgggaccctaccccggttcggtcccgtacccggttcctccctcgaccgcccctacccgaacccggaaccgggcccctacgttcccggttaccccgtttccccccgtacggtccccgtacccgtccgtcccgtacccgacgggaccgtacccgtaaccccgtaccggacggtaacccgaccgtaaccgacccggcccggtaccccggtgggtacccgtccggtacccgttacgggtacccgtaaaccgggttacccttacccgttacccgaacttaacgtttaacggtccggtccgtacgggg

SEQ ID NO: 264112 - DNA, 598 bp, Homo sapiens
  misc_feature: GYAE6OF01BWPH8.24.53.E09.1.454.CMB.1.raw
  modified_base (568)..(598): a, c, t, g, unknown or other
  misc_feature (568)..(598): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgacccccaaactcctacatttatacgtaaacaacaactccggcccttcgtcggggtccctggaccgtattccttcgccctacaagtctggccacctcacgcctcgctcggccatcacgtgggcctccaggctgaggatggagggtgattactactcgccaggttcggtacgaagtagtcgggttcgggacgggtaagggactaaggccgttacgtaccccggtaccgttaggtaccacgaccccgaaagggcccttaccggccccccgttaccgggtcctaacccttcccgttacccggtttaccccccctaccccttccccgtacctaaccgtacgttaacggttacttaccggtggaccgggtcgggtacgttcggacgaacgggccgacacgtgactgacnnnnnnnnnnnnnnnnnnnnnnnnnnnnnnn

SEQ ID NO: 264113 - DNA, 314 bp, Homo sapiens
  misc_feature: GYAE6OF01C5X6P.24.53.E09.1.454.CMB.1.raw
  modified_base (142)..(142): a, c, t, g, unknown or other
  misc_feature (142)..(142): n is a, c, g, or t
  modified_base (174)..(174): a, c, t, g, unknown or other
  misc_feature (174)..(174): n is a, c, g, or t
  modified_base (293)..(314): a, c, t, g, unknown or other
  misc_feature (293)..(314): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtnattactactgccagtcgtcgaagatgttcggnggagggactaagctgaccgtctaggtcagcccaaggcctcgccccctggtccacttcgtaccttccccaccctcctcactatagtactctggagcgggctggacgaaggcgacagtagnnnnnnnnnnnnnnnnnnnnnn

SEQ ID NO: 264114 - DNA, 286 bp, Homo sapiens
  misc_feature: GYAE6OF01ALBCM.24.53.E09.1.454.CMB.1.raw
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaaggcctcgccccctcggtcactctcgttccccnccctcctcacatagtagtctggagcgggctggcaaggcgcatagn

SEQ ID NO: 264115 - DNA, 296 bp, Homo sapiens
  misc_feature: GYAE6OF01BVQ80.24.53.E09.1.454.CMB.1.raw
  modified_base (283)..(283): a, c, t, g, unknown or other
  misc_feature (283)..(283): n is a, c, g, or t
  modified_base (285)..(296): a, c, t, g, unknown or other
  misc_feature (285)..(296): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccacccctcctcacatagtagtctgagcgggcttggcaaggcgcatagngnnnnnnnnnnnn

SEQ ID NO: 264116 - DNA, 299 bp, Homo sapiens
  misc_feature: GYAE6OF01DQ6GW.24.53.E09.1.454.CMB.1.raw
  modified_base (143)..(143): a, c, t, g, unknown or other
  misc_feature (143)..(143): n is a, c, g, or t
  modified_base (286)..(299): a, c, t, g, unknown or other
  misc_feature (286)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggcctccaggctgaggatgagggtnattactactgccagtcgtcgaagatgttcggcggagggactaagctgaccgtcctaggtccagcccaaggcctcgccccctggtcactctcgttcccacctcctacacaataatagtctgagcgggctggcaaggcgcatagnnnnnnnnnnnnnn

SEQ ID NO: 264117 - DNA, 306 bp, Homo sapiens
  misc_feature: GYAE6OF01B8BCC.24.53.E09.1.454.CMB.1.raw
  modified_base (284)..(284): a, c, t, g, unknown or other
  misc_feature (284)..(284): n is a, c, g, or t
  modified_base (289)..(306): a, c, t, g, unknown or other
  misc_feature (289)..(306): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcgggcggagggactaagctgaccgtcctaggtcacgcccaaggctcgcccctggtcactctcgttccccgccctcctcacatagtagtctgacggcgggctggcgaaggccganatagnnnnnnnnnnnnnnnnnn

SEQ ID NO: 264118 - DNA, 632 bp, Homo sapiens
  misc_feature: GYAE6OF01CLO6T.24.53.E09.1.454.CMB.1.raw
  modified_base (332)..(332): a, c, t, g, unknown or other
  misc_feature (332)..(332): n is a, c, g, or t
  modified_base (600)..(603): a, c, t, g, unknown or other
  misc_feature (600)..(603): n is a, c, g, or t
  modified_base (605)..(632): a, c, t, g, unknown or other
  misc_feature (605)..(632): n is a, c, g, or t
tcagactactatgtcacgaccggtgctcgatttagagagagtgtgttgagtttgggggctgtttttggaagctgcttgtaccagagggtcaccatctcctgcactggggagcaacatcggcgctaggttttgatgtcactggtacaagcagcttaccaaaaacacgcccccaaactcctctatttatacgtaacaacaactccggccctcgtcggggtccctacgaccgtacttcctcccgtcctaccaacgttctcggcctacctcacgcctcgcgtacggccactcacgtcgggcctaccgaggcgtaggaggtagtagggtaggggttntacttaccgtacgttcggaccgtacggttcgtacgaaaggtgttcggggttacggacgggtagggaactaacgggtcgtacggtacccgttcggttacggaccgtaccggacccgaacgggtcctccccggtcccccgttacggtacctaccgttcccttacccggttacccccctacccttccgtacctaaccgtagttaaccgggttgtcccgtggggaaccggtcccgggttcgacgggaccggaacggtccgaagaagttcgcnnnngnnnnnnnnnnnnnnnnnnnnnnnnnnnn

SEQ ID NO: 264119 - DNA, 723 bp, Homo sapiens
  misc_feature: GYAE6OF01CLJRE.24.53.E09.1.454.CMB.1.raw
  modified_base (186)..(186): a, c, t, g, unknown or other
  misc_feature (186)..(186): n is a, c, g, or t
  modified_base (689)..(689): a, c, t, g, unknown or other
  misc_feature (689)..(689): n is a, c, g, or t
  modified_base (693)..(695): a, c, t, g, unknown or other
  misc_feature (693)..(695): n is a, c, g, or t
  modified_base (697)..(723): a, c, t, g, unknown or other
  misc_feature (697)..(723): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagcttaccaaaaaccgacccccaaactcctcatttancgtaaacaacaatccggccctcgtcgggtccctgaccgattcctccgcctcaagtctggccacctcacgcctcgctcggaccatcacgtgggcctacgaggctaggaggtatcggagggttataactttaccgtaaccgtcggaccccgtaggttaccggtacgaaaaggttcgtttccggggttacggggaacggggtaacgggtaaaccgttaacggtccgttaccggtaaccccggtttaccggtaaggtccccgaacccggacccccggtaaagggtccccttacccccgggtcccccccgtttaacgggttacccctaacccgttttccccggttaacccccggttttacccccccaccccctttacccggtaaacctaacccgtttaaacgggttaaccggtttaaccggttccggttaacggggtaacccggggccgggttaccggttaacggggaacccggaaaccgggtccgtaacgtaacgtaggctgaccanctannnannnnnnnnnnnnnnnnnnnnnnnnnnn

SEQ ID NO: 264120 - DNA, 717 bp, Homo sapiens
  misc_feature: GYAE6OF01CQVB1.24.53.E09.1.454.CMB.1.raw
  modified_base (277)..(277): a, c, t, g, unknown or other
  misc_feature (277)..(277): n is a, c, g, or t
  modified_base (691)..(717): a, c, t, g, unknown or other
  misc_feature (691)..(717): n is a, c, g, or t
tcagactactatgtcacgaccggtgctcgatttagagagagtgtgttgggtttgggggcttgttttggaagctgcttgtaccaggagggtcaccatctcctgcagtggggagcaacatcggcgcgtaggttttgatgtccagtggtaacaagcataccttaaccaaaaaacaccgacccccaaaactcctactattagtactaaacaactaagtccggccctcgtcggggtccctgaccgtactccgtccgcctaccaagtccgtggaccacctacncgcctcgccgtcgcctactcaccggttcggggacctaccggaggtacgtaggaaggtagtaggggtacgggttagtaacgttacgtaagtccgtaccgtaggttaccgtaggtaaagtaacggtttcggggttaccgggagggtaaacgggtaaaccgttaacgggtacgttacccggtaccccgggtttaccttaaccggggaaccctaaacccggggtaaccccgtaaacggggccccgttcccccgggaaccccccgtttggtaaccccttccctttacccgtttaaccccgtccccccttaaaccctccccttaaaccgaacgttaacgttaacgggttacgttaacccggtcgggggaccggccgggggtaacccgtgggaaaccggtacgggaacgacgttaagacgnnnnnnnnnnnnnnnnnnnnnnnnnnn

SEQ ID NO: 264121 - DNA, 551 bp, Homo sapiens
  misc_feature: GYAE6OF01DGFSW.24.53.E09.1.454.CMB.1.raw
  modified_base (164)..(164): a, c, t, g, unknown or other
  misc_feature (164)..(164): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (466)..(466): a, c, t, g, unknown or other
  misc_feature (466)..(466): n is a, c, g, or t
  modified_base (515)..(516): a, c, t, g, unknown or other
  misc_feature (515)..(516): n is a, c, g, or t
  modified_base (518)..(551): a, c, t, g, unknown or other
  misc_feature (518)..(551): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccatggtaacaagcagcttaccaaaaacngacccccaaatcctnatttatcgtaaacaanaatcggccctgtggggtccctgaaccgnttccnccgcctcaagtctcggcacctnacncccgtgcgnggacccatccgaagttcggactccgaggctggaaggactaggaggtgtacttaactactacgcctaggtcggtacgaaagtacgtcgggttacgggacgggtaaggaactaaagccttacggaccttccgttaggccaacggaccccaaaaggtcctaaccgccccccgttaggtaccacgtcttcccggttaccccacctcanaactatacgtagtctaggcgcgggctacggacgaagacgacgtatacgnntnnnnnnnnnnnnnnnnnnnnnnnnnnnnnnnnnn

SEQ ID NO: 264122 - DNA, 644 bp, Homo sapiens
  misc_feature: GYAE6OF01D9GBC.24.53.E09.1.454.CMB.1.raw
  modified_base (111)..(111): a, c, t, g, unknown or other
  misc_feature (111)..(111): n is a, c, g, or t
  modified_base (178)..(178): a, c, t, g, unknown or other
  misc_feature (178)..(178): n is a, c, g, or t
  modified_base (562)..(562): a, c, t, g, unknown or other
  misc_feature (562)..(562): n is a, c, g, or t
  modified_base (618)..(618): a, c, t, g, unknown or other
  misc_feature (618)..(618): n is a, c, g, or t
  modified_base (622)..(644): a, c, t, g, unknown or other
  misc_feature (622)..(644): n is a, c, g, or t
tcagactactatgtcacgaccggtgctcgatttagagagagtgtgttgggtttgggggctgttttggaagctgcttgtaccagagggtcaccatctcctgcacgtgggganacaacagtccggcgcgtaggttttgattcgtcccagtggtaacaagcagtaccttaacccaaaaacncccgaaccccctaaactcctactattttaactaccgtaaacaacaacgtcccggtcccttcgggtcgggtcccctggaccgtacgttccctcccgtccctaaccgtaacgttccggtccggtacccacccttaccgaccgtcccgtccggccgttcggaccctaacgtccgtacggtccggggtacccttccccggaaggtccgtagggaacggtagttaggggtaaggtagttaacctttaacgtccgtcgacccgtaggtccgtaagaaggtcgtttcgggtaccgggagggtaacggtataacggtcgtaccggtaacccgtcgtacggaccgaccgaccgacgtccctcccgcccgtgtaccgtctccgtccctaccccncccgtacaccattacgtagtctcggtagacgggtccgtatcggaacaggccagtancggnnnnnnnnnnnnnnnnnnnnnnn

SEQ ID NO: 264123 - DNA, 709 bp, Homo sapiens
  misc_feature: GYAE6OF01CC9Z2.24.53.E09.1.454.CMB.1.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgctaggttttgatgtccactggtacaagcagcttaccaaaacncgccccaaatcctnatttancgtaaacaacaatccggccctcgtgggtccctgaccgattccgccncctccaagtctggcactcacgctacgctggccatacacgtcggactccgaggtcagacgtatcggagggtnagttacacgtgaccgtagtcgttacgaagtagtcggttacggcggaaaggtaccgtaagccgtttacggaccgttacccgtagggtaccgtacgacccccggtaaaggtccgtccggcccccctttagggtactaaccggttcggtaacccgtttacccccgaacccgttcccgtaaactaaccgggtttaataaccgggttaacgtttcggtaccgggaacgggttccggggacccgttaggaaccggttaaacgccggtaattaacgtaacggtcgaactggtactaggttcgtacgtacgtacgtacgtacgtacgtacgtacgtacgtacgtacgtacgtacgtacgtacgtacgtacgtacgtacgtacgacgtacgtacgtacgacgagtacgtcgtagtacg

SEQ ID NO: 264124 - DNA, 461 bp, Homo sapiens
  misc_feature: GYAE6OF01AVIZN.24.53.E09.1.454.CMB.1.raw
  modified_base (163)..(163): a, c, t, g, unknown or other
  misc_feature (163)..(163): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (439)..(461): a, c, t, g, unknown or other
  misc_feature (439)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaaactcctcatttatcgtaaacaacaatcggccctctggggtcccctgaccgattctccgcctccaagtctggcacctcagcctcgctggccatcactgggctccaggctgaggatgggggtgattactactgcccagtcgtcgaagatgttcggcggagggactaaactgaccgtctaggtcagcccaaggctgccccctcggtcactctgtcccaccctcctcacatagtagtctgagcgggctggaccaagggccncaatagntnnnnnnnnnnnnnnnnnnnnnnn

SEQ ID NO: 264125 - DNA, 538 bp, Homo sapiens
  misc_feature: GYAE6OF01BP47T.24.53.E09.1.454.CMB.1.raw
  modified_base (162)..(162): a, c, t, g, unknown or other
  misc_feature (162)..(162): n is a, c, g, or t
  modified_base (520)..(538): a, c, t, g, unknown or other
  misc_feature (520)..(538): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgccccccaaactcctcatttatcgtaaacaacaactcggccctcgtcggggtccctgaccgattcctccgcctccaagtcctggcacctcagtcctcgctggccatcactgggctccaggctgaggatgagggtgacttactactgccaggtcgtcggaagtattggttccggcgggagggactaaggctagacccgtcgtacggtccaacggtccccgaagggtccctaccggccccccgttcgggtccaaccttcccgtccgtttcccccaccccgttccctacctaacagttacgttacgttccgttacgggacggccgggtcgttacgggacgaacgggtcgacctagtagcnnnnnnnnnnnnnnnnnnn

SEQ ID NO: 264126 - DNA, 330 bp, Homo sapiens
  misc_feature: GYAE6OF01CJE96.24.53.E09.1.454.CMB.1.raw
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
  modified_base (288)..(330): a, c, t, g, unknown or other
  misc_feature (288)..(330): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtnattacactgccagtcgtacgaagatggtcggcggaggactaagctgaccgtcgtaggcacgccgaaggctcgcccctggcactctcgttcccacctcncactatagtacgtctggacggcgggtcaggacaagggtcactaagcgnnnnnnnnnnnnnnnnnnnnnnnnnnnnnnnnnnnnnnnnnnn

SEQ ID NO: 264127 - DNA, 634 bp, Homo sapiens
  misc_feature: GYAE6OF01D1GP2.24.53.E09.1.454.CMB.1.raw
  modified_base (169)..(169): a, c, t, g, unknown or other
  misc_feature (169)..(169): n is a, c, g, or t
  modified_base (242)..(242): a, c, t, g, unknown or other
  misc_feature (242)..(242): n is a, c, g, or t
  modified_base (539)..(539): a, c, t, g, unknown or other
  misc_feature (539)..(539): n is a, c, g, or t
  modified_base (576)..(577): a, c, t, g, unknown or other
  misc_feature (576)..(577): n is a, c, g, or t
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (608)..(608): a, c, t, g, unknown or other
  misc_feature (608)..(608): n is a, c, g, or t
  modified_base (610)..(612): a, c, t, g, unknown or other
  misc_feature (610)..(612): n is a, c, g, or t
  modified_base (614)..(614): a, c, t, g, unknown or other
  misc_feature (614)..(614): n is a, c, g, or t
  modified_base (617)..(619): a, c, t, g, unknown or other
  misc_feature (617)..(619): n is a, c, g, or t
  modified_base (621)..(623): a, c, t, g, unknown or other
  misc_feature (621)..(623): n is a, c, g, or t
  modified_base (625)..(627): a, c, t, g, unknown or other
  misc_feature (625)..(627): n is a, c, g, or t
  modified_base (629)..(634): a, c, t, g, unknown or other
  misc_feature (629)..(634): n is a, c, g, or t
tcagactactatgtcacgaccggtgctcgatttagagagagtgtgttgggtttgggggctgtttttggaagctgcttgtaccagaggtccaccatctcctgcactgggagcaaacatcggcgctaggttttgatgtccacgtggtacaagcagtccttaaccaaaaacncgaccccccaaatcctatatttataccgtaaacaacactcggccctcgtcgggtccctgacctattcctcccncctaccgaagttctcggccacctcacgtccctcgcgtgacccatcgacgtcgggccttaccgagggtctacggaggtaacgtgggtaaggggttctaacgtttaaccaaccgttcggacccgttaaggttcgttaaccgggaagtacgtttcgggttaccggggacgggaacggtaaccgtacgtccgtacggtaacccgttacgtacggtaccaccgtacccgacggtcctccccggccccgttagtcctaccttccgttcctccccctacctcctacgactagttacgtacgtcngggtacgcgggtgtacggcgtaacgccgagtagcgtnncgancggtacngaactgactcgtntancgtncnnncncgnnntnnncnnncnnnnnn

SEQ ID NO: 264128 - DNA, 584 bp, Homo sapiens
  misc_feature: GYAE6OF01AJTU7.24.53.E09.1.454.CMB.1.raw
  modified_base (164)..(164): a, c, t, g, unknown or other
  misc_feature (164)..(164): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (554)..(584): a, c, t, g, unknown or other
  misc_feature (554)..(584): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgctaggttttgatgtccactggtacaagcagcttaccaaaaacncgacccccaaactcctctatttatcgtaaacaacaatccggcccttcgtcggggtcccctgaccgtacttcctcccgcctccaagtccgtcggccacctcacgccctcgctcggcccatccacgtcgggcctccgacggcgtggaggagtaggaggggtgtacttactacgtcgccgtacgtcggacgtttttttaagagttcggttcgggcgggagggtactacgcgtcgaccgttcgtacggtcgacgacccgaacggccgtccgtcccccgtcggtcctccgttccgttccgttcccccgtccccgtccctaccaacctacgtacggttacgtcgtcggacggtcgggtccggtcggaccgtaacgggccgactagtacgncgnngnnnnnnnnnnnnnnnnnnnnnnnnnnnnnnn

SEQ ID NO: 264129 - DNA, 663 bp, Homo sapiens
  misc_feature: GYAE6OF01DKEOY.24.53.E09.1.454.CMB.1.raw
  modified_base (228)..(228): a, c, t, g, unknown or other
  misc_feature (228)..(228): n is a, c, g, or t
  modified_base (627)..(627): a, c, t, g, unknown or other
  misc_feature (627)..(627): n is a, c, g, or t
  modified_base (630)..(634): a, c, t, g, unknown or other
  misc_feature (630)..(634): n is a, c, g, or t
  modified_base (636)..(663): a, c, t, g, unknown or other
  misc_feature (636)..(663): n is a, c, g, or t
tcagactactatgtcacgaccggtgctcgatttagagagagtgtgttgggtttgggggctgtttttggagctgcttgtaccagagggtcaccatctcctgcactgggagcaacatcggcgctaggttttgatgtccactggtacaagcagcttaccaaaaacacgcccccaaatcctctattttatcgtaacaacatccggccctgtcggggtccctgaccgattccnccgcctcaagtctggccacctcacgtccctcgcgtcggcctatccacgtcgggtcctaccgaggtctagggacggagttagggaggggttactaactttaaccgtaccgtcgtaccgtacggttacggaacggtaaaggttcggtttacggggtaccggggtaacggggaaccggtaaacgttaacccggtccggttaacccggtaaccccggttacggtaacggtacccgaaccggtaaccccggtaacggttcccccggtaccccccggtcccgtttaccggtacccttcccggtcccgtttccccgtcccccgtacccttctaccaacgttacgttaacgtcgttacggaacgggtccggcgggtacacggggaacgaacggtcctaagtagcggncgnnnnngnnnnnnnnnnnnnnnnnnnnnnnnnnnn

SEQ ID NO: 264130 - DNA, 299 bp, Homo sapiens
  misc_feature: GYAE6OF01DAO7V.24.53.E09.1.454.CMB.1.raw
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (286)..(299): a, c, t, g, unknown or other
  misc_feature (286)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagcccaaggctcgcccctcggtcactctcgttccccnccctctcacatagtagtctgaggcgggctggcaaggcncgaatagnnnnnnnnnnnnnn

SEQ ID NO: 264131 - DNA, 803 bp, Homo sapiens
  misc_feature: GYAE6OF01AMBU3.24.53.E09.1.454.CMB.1.raw
  modified_base (105)..(105): a, c, t, g, unknown or other
  misc_feature (105)..(105): n is a, c, g, or t
  modified_base (152)..(152): a, c, t, g, unknown or other
  misc_feature (152)..(152): n is a, c, g, or t
  modified_base (300)..(300): a, c, t, g, unknown or other
  misc_feature (300)..(300): n is a, c, g, or t
  modified_base (687)..(687): a, c, t, g, unknown or other
  misc_feature (687)..(687): n is a, c, g, or t
tcagactactatgtcacgaccggtgctcgatttagagagagtgtgttgggtttgggaggcgttggtccagccgtgggggtccctgagactctcctgtgcagcctntggtacttcccctttagtgtacttttggatcgaccgtgggtccgccnggtctccgaggggcgggctgggaggtggggtgaccgtaatagtaaggcctacggagtgggaacgtgctaattgtactagtggtggaccttcgtggtaggaacgggtcctagttccaacctcttcaccgaggacgaccaacgcccgaanacgtcacgtacgtatacgtaggaaactcgaccgacgcgtaggacggttacgacgggtacgaccggtacgacgttgtaacgtttacgtacgttacggtaccggacccgtaacttacgtaacttccgaaccggacccgtaccggttagggtaaccggtccgtacgtcttaacggtactttaaacggtaccctttaccggacgttcggtttaaaccggggtccggtaccggtaaccgggccccgttaccggtaccggttacccgttaacccttccgttaccccgtaccgtaaccccgttccgaccccgttaacgacccggtacccgttacgtcccggttcccgtcccgttaccggcccgtacccgttaccgccgttaccggcggtacccnccgaccgttaccgaagccgtacgaccgtcggtccccggtacgtccggtaccgccggttacccgtcgggtactaccggtacctacgtacccaggttaactcggtacggtcgtacggg

SEQ ID NO: 264132 - DNA, 688 bp, Homo sapiens
  misc_feature: GYAE6OF01AFVJ3.24.53.E09.1.454.CMB.1.raw
  modified_base (153)..(153): a, c, t, g, unknown or other
  misc_feature (153)..(153): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (615)..(615): a, c, t, g, unknown or other
  misc_feature (615)..(615): n is a, c, g, or t
tcagactactatgtcacgaccggtgctcgatttagagagagtgtgttgggttgggctgttttggaagctgcttgtaccagaggtcaccatctcctgcactggagcaacatcgcgcaggttttgatgtccactggtacagcagccttcaaaacngtaccccaaactcctacagtttatcgtaacaacaactcggccctcgtcggggtccctggaaccgtagttccgtccgccctccgaacgttcgtcgggaccacctcacggtcctcgactcggaccagttccacgtcggcctccgaggccttaggacggtatcgggtaggttcgtacgtttaaccacgttcggaccctaggttaccgtaaccggtaacggtacgtttaccggtttacgggaccgggtaacggggtaaccttaaggacccgttaggaccccgtttccgtacgggtttccgaacggaccccgtaacgggtcccgtcccggtaccccccggtgttacccgtacttccgttccgttaccccacccgtccttacgacctacgtacgtacgtcgagacggtcggacgtcgtacgacggtcgtacgacgtagacgtgaacngcgngtacgctcgaactggtnacgtcgtataccggcgtcgacgcgtagacgtacgtcgacgtcgtcgtaccgacgtctactacacgtagtctcg

SEQ ID NO: 264133 - DNA, 676 bp, Homo sapiens
  misc_feature: GYAE6OF01EK745.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (294)..(294): a, c, t, g, unknown or other
  misc_feature (294)..(294): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
  modified_base (606)..(606): a, c, t, g, unknown or other
  misc_feature (606)..(606): n is a, c, g, or t
  modified_base (672)..(672): a, c, t, g, unknown or other
  misc_feature (672)..(672): n is a, c, g, or t
tcagactactatgtcacgaccggtgctcgatttagagagagtgtgttgggttggggctgttttggagctgcttgtaccagagggtcaccagtctcctgcacgtgggagcaacattcggcgcaggttttgatgtccactggtacaagcagcttaccaaaaacngcccccaaatcctcatttancgtaacaacatcggcctctgggtccctgaccgattctccgccttcaagtctcggctacctcgacgcctcgctggccatcactgggctccgaggctgacggtatggacgggtnaacgttactacgtgccccaggttccgtacggaaagtcgttcggttccgggacgggtagggaacttaacggcgttcgaaccgttcctaaggggtcaacggccccgtaaagggcccttcggacccccttgggtaccctaacgttccgtccgggtttaccccccgacccgtttaccgtacaccggttaattaacgggttacttaccgtacgggaacggtccgggggtacctcgggtaacccaggggacccttacgaacggtttaacggnacggttacacttcgggctacganccgtttagcctacccgggttaanctcgcgacgtacgacgtacgtacgtacgtacgtatacgtctacgtagtacgtacgtacatacgtcncgcg

SEQ ID NO: 264134 - DNA, 947 bp, Homo sapiens
  misc_feature: GYAE6OF01D1ILS.24.53.E09.1.454.CMB.1.raw
tcagactactatgtcacgaccggtgctcgatttagagagagtgtgttgggtttgggaggcttggtccagccctggggggtccctgagactctcctgtgcagcctctggactttcccctttagtgtacttttggatgacctgggtccgccaggctccgagggccgggctggacggtgggtcggaccaatagtaaggcacgatggacgtagcatgtactagtgtggactcgtgtaggacggccgtacttcaaccgtattccacccgaagaacgaaccaaaccggccccaaacgtaaccttcctacgttacgtactttaccgtaagggtaaaacttaccggaacccgaacggtaccccgttagggaaccggtaagggttaccgggtaaacgggaaacccggtaccggggtaacctttaaaggtttacggttttaaaccggttttaacccgttggtttaccgggaacccgtaaacccggtttaactaaacggttaacccgaccggaccgttaacccgggtttacggggaaacccggtttccgaaaccgttaacttaaccggttaacgggtttaaaaactttaccccgtttaacccgaaccgggttaaccggtacggggtttacccgggggaccccgtaaacccgggggtaccccgttaccccggttaccggggttaccccttaaccccgggtttaaccccttccccgtaccgtaccccgttaccccgtaccccggtaaccggtaaccccgggtaccccggttacccgttcccggtttcccccgttaccccgtccgggtacccgtcccgtaccgtcgtccgacggtccaccgacccgtacgaacgaccgaccgaaccgtccggcccggtcccgtcggtacccgtcggttcccgacggttacccgaacggttaccctaccgttacccaactaggtacgttcggtcgtacgggg

SEQ ID NO: 264135 - DNA, 320 bp, Homo sapiens
  misc_feature: GYAE6OF01CGG3Q.24.53.E09.1.454.CMB.1.raw
  modified_base (168)..(168): a, c, t, g, unknown or other
  misc_feature (168)..(168): n is a, c, g, or t
  modified_base (296)..(320): a, c, t, g, unknown or other
  misc_feature (296)..(320): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtacgaaagntggttcggcggagggactaagctgaccgtcctaggtcagcccaaggctcgccccctcggtcactctcgttccccgccctacctcacatagtagtctggacggcggggctgggacaaaggcgctaatgnnnnnnnnnnnnnnnnnnnnnnnnn

SEQ ID NO: 264136 - DNA, 387 bp, Homo sapiens
  misc_feature: GYAE6OF01DISI2.24.53.E09.1.454.CMB.1.raw
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (359)..(387): a, c, t, g, unknown or other
  misc_feature (359)..(387): n is a, c, g, or t
tcagactactatgtcacgaccggtgctcgatttagagagagtgtggttggggtttggggggtgtggtggtctccactcccgccttgacggggctgctatctgcctcgctcggccatcacgtgggctccgaggcgtggagggagtggtagggtagtaacttacctactcgccgagtcggtacgaagtagttcggttcgggacgggaagggaactaagcgtacggacccgttaccgtacggtcgaccgaccgacggcctccgccccgtcgtacctactccttccgttccccaaaaaaccctcctacactagtacgtacgtacgtaggacggtcggtcggtaggacggacggacganagngnnnnnnnnnnnnnnnnnnnnnnnnnnnnn

SEQ ID NO: 264137 - DNA, 603 bp, Homo sapiens
  misc_feature: GYAE6OF01BGZYA.24.53.E09.1.454.CMB.1.raw
  modified_base (542)..(542): a, c, t, g, unknown or other
  misc_feature (542)..(542): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (577)..(578): a, c, t, g, unknown or other
  misc_feature (577)..(578): n is a, c, g, or t
  modified_base (584)..(584): a, c, t, g, unknown or other
  misc_feature (584)..(584): n is a, c, g, or t
  modified_base (589)..(591): a, c, t, g, unknown or other
  misc_feature (589)..(591): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(602): a, c, t, g, unknown or other
  misc_feature (601)..(602): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgacccccaaactcctctatttatacgtaacaacaatcggccctcgtcggggtccctgaccgtattcctccgcctaccaagtctggccacctcacgcctcgctcggccatccacgtgggctccaggctgacggagtggacgggtgtattacctcgtcgaccgacgttccgtacggaaaggtcgttcgggttacgggaccgggtaagggtaactaacggccgttacggacccgttaccgtacggtccgacggaccccaagggtccctccggcccccgttcggtcctaccttcgtcccgttccccaccccttcctaccgtaactacgtaaggttacgtcgtcggacgggtcggcgtacggacgacggtcgacgtagtacgnatgactgcagcagngtacncgacngtngnngcgcnncgtcgncgcgnnntcgcgncngnng

SEQ ID NO: 264138 - DNA, 330 bp, Homo sapiens
  misc_feature: GYAE6OF01BR7DT.24.53.E09.1.454.CMB.1.raw
  modified_base (143)..(143): a, c, t, g, unknown or other
  misc_feature (143)..(143): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (295)..(297): a, c, t, g, unknown or other
  misc_feature (295)..(297): n is a, c, g, or t
  modified_base (299)..(330): a, c, t, g, unknown or other
  misc_feature (299)..(330): n is a, c, g, or t
tcagactactatgtcacgaccggtgctcgatttagagagagtgtgttgggtttgggggtgtggtggtctccactcccgccttgacgggctgctatctgcctcgctggccatcacttgggctccaggctagaggatggagggtntaattactatgcctagtccgtagaagtagttggttcggacggagggactaagctcgaacctcctaggccacgccgaaggcctcggcccctggtcacgtctcgtccccacctcctcanatcgtagtcngggancggcacggacgacgcanagnnntnnnnnnnnnnnnnnnnnnnnnnnnnnnnnnnn

SEQ ID NO: 264139 - DNA, 644 bp, Homo sapiens
  misc_feature: GYAE6OF01B6ZQG.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccgagggacggggctggagtgggtggccaatataaggcacgatggacgtagcatgtactatgtggactctgtgaaggccgattcaccatctccagacgacaacgcccagaactcactgtatctaggaaatgaccagcctgagagtcgaggacacggctatgtaattactgtgccgactatatcagcaaccgtggagtcgcatcagtaactacttaccagtcctaaggttcggggaccaggggccacccgtcggtacctaccggtctcctcgacgccctaccaccgaacgggcccacgttccccgtacttccccccgtcggtacccgcccgttcgcccgtaccggacggacgtcccgtacccgtaccgtaacggacgacccaaccgacggcccgggtaccccgtcggggtacccgtccggtccgttacgggttacccaaacgggtaacccttaaccttaccccgaacgttactaacggttccggtcgttaccggg

SEQ ID NO: 264140 - DNA, 565 bp, Homo sapiens
  misc_feature: GYAE6OF01CYKFR.24.53.E09.1.454.CMB.1.raw
  modified_base (120)..(120): a, c, t, g, unknown or other
  misc_feature (120)..(120): n is a, c, g, or t
  modified_base (162)..(162): a, c, t, g, unknown or other
  misc_feature (162)..(162): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (321)..(321): a, c, t, g, unknown or other
  misc_feature (321)..(321): n is a, c, g, or t
  modified_base (529)..(529): a, c, t, g, unknown or other
  misc_feature (529)..(529): n is a, c, g, or t
  modified_base (531)..(534): a, c, t, g, unknown or other
  misc_feature (531)..(534): n is a, c, g, or t
  modified_base (536)..(565): a, c, t, g, unknown or other
  misc_feature (536)..(565): n is a, c, g, or t
tcagactactatgtcacgaccggtgctcgatttagagagagtgtgttgggtttgggggctgttttggaagccgcttgtaccagagggtcaccatctcctgcactgggagcaacatcggcnctaggttttgatgtccactggtacagcagcttaccaaaaacncgaccccccaaactcctactatttatacgtaacaactaatccggccctcgtcggggtccctgaccgnttccncccgcctccaagtcgtggccacctcacgcctcggctcggaccatcgacgtcgggcctcccggaggctaggaaggagtagggagggtntacttactcgtcgccgtaggtccgtagagtagtcgggtacgggcgggtaaggacttaacgcgtacgacccgtcgtaggtcacgaccgacggtcctcccgtcccccgtggtactacccgtcgtttaccccgtccccgaccctcctaccgtaatacgttagtacgtcgtaggacggtccgggtcgtacggacggtacggcgtacagacgncnnnnannnnnnnnnnnnnnnnnnnnnnnnnnnnnn

SEQ ID NO: 264141 - DNA, 445 bp, Homo sapiens
  misc_feature: GYAE6OF01CBMI3.24.53.E09.1.454.CMB.1.raw
  modified_base (377)..(377): a, c, t, g, unknown or other
  misc_feature (377)..(377): n is a, c, g, or t
  modified_base (380)..(445): a, c, t, g, unknown or other
  misc_feature (380)..(445): n is a, c, g, or t
tcagactactatgtcacgaccggtgctcgatttagagagagtgtggttggggtttggggggtgtggtggtctccacctcccgccttgacggggctgctatctgcctcgctggccatcactgggctccaggctgaggatggagggtgattactactgccagtcgtacgaagtattcggttcggacgggaggggtactaaagctggacccgttcgtacggtcacgacccgaaggcctccgccccccgtcggtccaccgttccttcccggttcccccctaacccccttccctacctacgtaagtttacggttaacgttccgtaagggcgggcccgggggtacggttaggggacccgaaaggggccgaaccgttaagtagntannnnnnnnnnnnnnnnnnnnnnnnnnnnnnnnnnnnnnnnnnnnnnnnnnnnnnnnnnnnnnnnnn

SEQ ID NO: 264142 - DNA, 582 bp, Homo sapiens
  misc_feature: GYAE6OF01CPE6I.24.53.E09.1.454.CMB.1.raw
  modified_base (164)..(164): a, c, t, g, unknown or other
  misc_feature (164)..(164): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (551)..(552): a, c, t, g, unknown or other
  misc_feature (551)..(552): n is a, c, g, or t
  modified_base (554)..(555): a, c, t, g, unknown or other
  misc_feature (554)..(555): n is a, c, g, or t
  modified_base (557)..(582): a, c, t, g, unknown or other
  misc_feature (557)..(582): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttacccaaaaacncgaccccccaaatcctcattttatcgtaacaacaatccggccctcgtcggggtccctgaccgtattcctccgcctccaagtctggccacctcacgccttcgctcggccatccacgtcgggcctccgagggctaggaggtagtaggaggggtctaatttacctaacgtgccccgtaaggttccgtacggaaagcgttcggttcggggacgggaagggtaactaaggcctcggaacccgtcgtaaggtccacgacccgaagggcctaccgccccccgtggtccaccttccgtcgttcccccgacccctctccaacgttctacgtacgttcgtaggacgggtccggggacgtacgggacgaaacggccgtacgtaacgtggangngnngnncnncnnnnnnnnnnnnnnnnnnnnnnnnnn

SEQ ID NO: 264143 - DNA, 304 bp, Homo sapiens
  misc_feature: GYAE6OF01EVQ9F.24.53.E09.1.454.CMB.1.raw
  modified_base (235)..(235): a, c, t, g, unknown or other
  misc_feature (235)..(235): n is a, c, g, or t
  modified_base (286)..(304): a, c, t, g, unknown or other
  misc_feature (286)..(304): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactagctgacgtcctaggtcagcccaaggctcgcccctcgtcactctcgttccccnccctcctcacagtagttagtctgacggcgggcctggcaacggcgacatagnnnnnnnnnnnnnnnnnnn

SEQ ID NO: 264144 - DNA, 692 bp, Homo sapiens
  misc_feature: GYAE6OF01EVWFZ.24.53.E09.1.454.CMB.1.raw
  modified_base (238)..(238): a, c, t, g, unknown or other
  misc_feature (238)..(238): n is a, c, g, or t
  modified_base (653)..(653): a, c, t, g, unknown or other
  misc_feature (653)..(653): n is a, c, g, or t
  modified_base (656)..(657): a, c, t, g, unknown or other
  misc_feature (656)..(657): n is a, c, g, or t
  modified_base (661)..(663): a, c, t, g, unknown or other
  misc_feature (661)..(663): n is a, c, g, or t
  modified_base (665)..(690): a, c, t, g, unknown or other
  misc_feature (665)..(690): n is a, c, g, or t
  modified_base (692)..(692): a, c, t, g, unknown or other
  misc_feature (692)..(692): n is a, c, g, or t
tcagactactatgtcacgaccggtgctcgattttagagagagtgtgttgggtttgggggcttgtttttggaagctgcttgtaccaggagggtcaccatctcctgccacgtggggagcaacagtccggcgctaggttttgatgtccacgtggacaagcagccttaaccaaaaacgtccgacccccctaaactcctactatttactacgtaaacaactactccggccctgtcgggtcccncgacctcttccgcccgcctaccgagttcgcggccaccctcgaccgcccgtccgctcggaccctataccgtacggccggcctacccggaggtccgtaggacggtagtcggggtaaggggtcttaaactttaccgtacgtccgaccggtaggtacccggttaggaaacgtcggttacgggtccggggacgggtaacggtaataaccggtcgttacccggtacccggttacttacgggccgaacccggtacccggtaaacggtcccccggttacccccggtcccccggtttacggttccctacccgtttcccgttaaccccccggtcccccttaccccgtccctacgtaacttacggtttaggtccgttaccggtagggccggcggggtacgtacgggacgacgccgacgttaaccgngannagtnnngnnnnnnnnnnnnnnnnnnnnnnnnnngn

SEQ ID NO: 264145 - DNA, 1049 bp, Homo sapiens
  misc_feature: GYAE6OF01CQ2XQ.24.53.E09.1.454.CMB.1.raw
tcagactactatgtcacgaccggtgctcgatttagagagagtgtgttgggtttgggaggcttggtccagccgtggggggtccctgagactctcctgtgcagcctctggattcccctttagtgtactttttggatgaccgtgggtccgccaggcctccgaggggacggggctgggaggtggggtggaccaataagtaaggcacggaatggaacgtagctagtgtactagtgtacggtactcgtgtggaacgggccgtaattccaacctatcctaccgaagacgaaccgaaccgccaagtaaacctcaacgttgtacttcgtaaggtaaatcgaacctacggcctaggaggtacggtacggaggaaccgaccggtcttagttacgttaacttaccggtggtacggacccaaacctaattacaccgtaacgaccgttaccgtagggggtaaccttccggacttaaccgttcgttaacggtaaaacttttaaccccgtccggtaaacggttaccggtttaacgggggttaccgggggaacccccgtaacggggggtacccccttaaccccgttaccgggggttacccaaccccgggttttcccctacccggttaaccccaacccggtaccccccgttaacccgaaacccccggggtaaaccccgggttaccccgaaccccggggttttcccccgggtttaacccccccgtttccccccccgggtcggggtaccccccccgttacccccgggtttccggtcccccggttaaaccccggaacgggggttaaccccccgttaaccccccggtaccccggggttaaacccccgggtaacccgggaacccggtacccgggtaacccggaaacccgggggtaccccccgggtcccccgggggtttaccggtaccccggggtttaccgggtcccccgggtttaaacggggttaaacccccggtaaaaccccggggttaaccccttttaaacccccgttacccgtaaaacccggttttaagtaaacccgggtttacggtttacccgggtaaacccgggggg

SEQ ID NO: 264146 - DNA, 553 bp, Homo sapiens
  misc_feature: GYAE6OF01DQKE3.24.53.E09.1.454.CMB.1.raw
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
  modified_base (524)..(553): a, c, t, g, unknown or other
  misc_feature (524)..(553): n is a, c, g, or t
tcagactactatgtcacgaccggtgctcgatttagagagagtgtgttgggtttgggggctgtttttggagctgcttgtaccagagggtcaccatctcctgcactgggagcaaacatcggcgctaggttttgatgtccactggtacaagcagcttaccaaaaacacgcccccaaactcctcattttancgtaacaacatccggcctgtcggggtccctgaccgtnttcctccgcctcaagtcctggccacctcagcctcgctggcccatcacgtcgggctccagctgaggtctggagggtntattcgtactcgcctagtcgtacggaagtagtggttcgggcggagggactaacgcctcgaccgtcgtaggtcagaccccaaggcccttccggccccccgttggtccctccttaccgtcccgtttaccccccacccttacccacgtaacgtagttaacggttacgttccggtacggacgggtacccgggggcgtacggggtaaccaacgggcctctaagtagctnnnnnnnnnnnnnnnnnnnnnnnnnnnnnn

SEQ ID NO: 264147 - DNA, 698 bp, Homo sapiens
  misc_feature: GYAE6OF01B0MCL.24.53.E09.1.454.CMB.1.raw
  modified_base (663)..(663): a, c, t, g, unknown or other
  misc_feature (663)..(663): n is a, c, g, or t
  modified_base (673)..(673): a, c, t, g, unknown or other
  misc_feature (673)..(673): n is a, c, g, or t
  modified_base (675)..(698): a, c, t, g, unknown or other
  misc_feature (675)..(698): n is a, c, g, or t
tcagactactatgtcacgaccggtgctcgatttagagagagtgtgttgggtttgggggcttgtttttggaagctgcttgtaccagagggtcaccatctcctgcacgtgggacgacaaacagtcggcgcgttaggttttgattcgtaccacgttaggtaacaagcaacgtaccttaaaccaaaaaaccgacccgaacccccctaaaaccttcccttacttaattttaacgtaaccgtaaacaaacctaaacggtcccggtccccttcgggttccggggtaccctacggtaaccctactttccccgtcccgtaccctaccgtaaagtccgtcggaccctaccgtaccgtaccgtccctcggtcccgtacggacccttacgtaccgtaccgggtcggtacccgttacccgagggttccgaaggggtaaggtagggttagggtaacggggtacttaacgttacgtaccgacgacgtacggtacgttaacgaagttcgtcggtacgggacggtaacgtagacggtcgtacggaccgttacggagtaccgaacgtaccgacggttccgcccgtcccggtactcgtacccttccgtcccgttaccccctacctccaactaacgttaagtcggtacgtagtcgggacggtcgggtacgacggtacgacgtnaccgtagacngnnnnnnnnnnnnnnnnnnnnnnnn

SEQ ID NO: 264148 - DNA, 822 bp, Homo sapiens
  misc_feature: GYAE6OF01C27SO.24.53.E09.1.454.CMB.1.raw
  modified_base (790)..(790): a, c, t, g, unknown or other
  misc_feature (790)..(790): n is a, c, g, or t
tcagactactatgtcacgaccggtgctcgatttagagagagtgtgttgggtttggaggtctcagagaggagccttagccctggagtccaaggcctttccacttggtgatcagcactgagcacagaggactcaccagtggaattggggctggagtcgttgggtttttccttgttgtcttattttaggaaggtgtccagtgtgaggtgcaacgtggtggagtcgtgggggtagtcgttcggtccacggtccggtcggggggtaccctggacgtaccttccgtccgtggtcgacgtacgtccctcgttcggtaccttttccccgttagttcgttacgttttggattcggtaccgtcgggtcccgccgacggtccgaccggacggggccggggcgtgggaggtcggggtacgacccgtaaagttaacggtaacgggacctaacggtacgtcgggtaaccggttacgacgttaagttacgttaacgttaggttacgggtaccggtaccttacgggttaacggtacggggtaaacccgggtcccgttacgttaaccccgaacccttaccgttacccgtaaccggaacggtaaaccgtaaacccgaaccccggtaaccccgtaagtaaacccttaccggtaacccgttagttaaccgttacggtaaacggtaaacgtttaccggaaccgtaaccggtaccgttaaggacgggtaaaccgggttccggaacgggtaacccgtacggtaagtttacgtacggttatttacggtcggtacgtaccgacctagtaccgtanacgtaccggtacgtaggtaccgcgtacgtacg

SEQ ID NO: 264149 - DNA, 285 bp, Homo sapiens
  misc_feature: GYAE6OF01DVKQN.24.53.E09.1.454.CMB.1.raw
  modified_base (141)..(141): a, c, t, g, unknown or other
  misc_feature (141)..(141): n is a, c, g, or t
  modified_base (283)..(285): a, c, t, g, unknown or other
  misc_feature (283)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtnattactactgccagtcgtcgaagatgttcggcggagggactaagctgaccgtctaggtcagcccaaggctcgccccctcggtcactctcgttccccaccctcctcacatagtacgtctgagcgggctggcaaggcgcatagnnn

SEQ ID NO: 264150 - DNA, 609 bp, Homo sapiens
  misc_feature: GYAE6OF01D0YB0.24.53.E09.1.454.CMB.1.raw
  modified_base (167)..(167): a, c, t, g, unknown or other
  misc_feature (167)..(167): n is a, c, g, or t
  modified_base (227)..(227): a, c, t, g, unknown or other
  misc_feature (227)..(227): n is a, c, g, or t
  modified_base (575)..(575): a, c, t, g, unknown or other
  misc_feature (575)..(575): n is a, c, g, or t
  modified_base (579)..(609): a, c, t, g, unknown or other
  misc_feature (579)..(609): n is a, c, g, or t
tcagactactatgtcacgaccggtgctcgatttagagagagtgtgttgggtttgggggctgtttttggaagctgcttgtaccagagggtcaccatctcctgcactggggagcaacatcggcgctaggttttgatgtccactggtaacaagcagccttaccaaaaacncgacccccaaacttcctctattttatcgtaaacaacaagtccggccctcgtcgggtcccngaccgtattctcccgccttccaagtctcggcacctcacgccctcgctcggcctatccgacgtgggcctccgaggctgaggatggaggttagtattactacgttcgccgtaggtccgtagaaacgtgttcgggtaccgggacgggtaacggtaactagtccgtacgtccccgtacgtaacgggccaaaccggccccgtaagggcccttaccggcccccccttcgggtacccaccgttcccgttacccgtccccccggtcccttaccgtactaaccgtaagtttcgtaacggttcctacgggtaccggtccgggggtcttaacgggaccgtaacggggcccaagtagtanagcnnnnnnnnnnnnnnnnnnnnnnnnnnnnnnn

SEQ ID NO: 264151 - DNA, 522 bp, Homo sapiens
  misc_feature: GYAE6OF01DZI7X.24.53.E09.1.454.CMB.1.raw
  modified_base (139)..(139): a, c, t, g, unknown or other
  misc_feature (139)..(139): n is a, c, g, or t
  modified_base (262)..(262): a, c, t, g, unknown or other
  misc_feature (262)..(262): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (491)..(522): a, c, t, g, unknown or other
  misc_feature (491)..(522): n is a, c, g, or t
tcagactactatgtcacgaccggtgctcgatttagagagagtgtggttgggtttgggagcaacatcggcgcagggttttgatgtcccatggtaacaagcagcttaccaaaaaacacgccccccaaactccctcatttancgtaaacaacaatcggccctctggggtccctgaccgattctccgcctcaagtctggccacctcagccctcgctggcccattccacgtcggggcctccgaggctaggaagggatcggaggggtnattaacctacctggcctaggtcgtacggaaaggtacgttggttccggggacgggaagggaactaaagccgtacgacccgttaccgtaggtccaacggcccgaaacggtcctacccggccccgttcggtccaccgttccgttccgttcccccgccccttaccctacgaacctagttacggttacgtctggacggtcgggtctacgccggaaggccncaagtgnatngacnnnnnnnnnnnnnnnnnnnnnnnnnnnnnnnn

SEQ ID NO: 264152 - DNA, 684 bp, Homo sapiens
  misc_feature: GYAE6OF01BDYYQ.24.53.E09.1.454.CMB.1.raw
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
  modified_base (419)..(419): a, c, t, g, unknown or other
  misc_feature (419)..(419): n is a, c, g, or t
tcagactactatgtcacgaccggtgctcgatttagagagagtgtgttgggtttgggaggcttggtccagccgtggggggtccctgagactctcctgtgcacgcctcgtggtactttcccctttagtgtacttttggatgaccgtgggtccgccaggctccgaggggaccggggctggaggtgggtcgaccaaatagtaaggcaacgtagtgggacgtagctaatgtactagtgtcggactgtgtaggaacgggtccattaccgacctatcctaccgaagacgaccaaccggtcccaagaacctctactagtactcgtaggaaatcggaaccngtacctggagacggtacgacggacgtacggtacttagttagttacttacgnggtacgaccgtaacctagtaactacgacggtacccncggttacggacgtactcgaacttcgttaagaaacctttccttacgagtacgtacgggttcgggcgtaacgggccctccggtacggtcccgtacgtcctacgcaccgtccaccgacgaccgcctcgtccgtcccttcccgcggtccctccgactcgccgtacggccgtccgaccgtacgacgtacgccgtacgcggtccggccggtcggtcccgtggtccgacggtcgacgtacctaccgtaccaacgttatacgtgtcggtacgg

SEQ ID NO: 264153 - DNA, 308 bp, Homo sapiens
  misc_feature: GYAE6OF01ECSEM.24.53.E09.1.454.CMB.1.raw
  modified_base (289)..(308): a, c, t, g, unknown or other
  misc_feature (289)..(308): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacatacgttagtctggaggcgggctggcgaaggcgacatagnnnnnnnnnnnnnnnnnnnn

SEQ ID NO: 264154 - DNA, 375 bp, Homo sapiens
  misc_feature: GYAE6OF01B6MHV.24.53.E09.1.454.CMB.1.raw
  modified_base (144)..(144): a, c, t, g, unknown or other
  misc_feature (144)..(144): n is a, c, g, or t
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
  modified_base (291)..(293): a, c, t, g, unknown or other
  misc_feature (291)..(293): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (303)..(375): a, c, t, g, unknown or other
  misc_feature (303)..(375): n is a, c, g, or t
tcagactactatgtcacgaccggtgctcgatttagagagagtgtgttggggttttagggggtgtggtggtctccactcccgccttgacggggctgctatctgcctgctggccatcactgggctccaggctgaggatggagggtnattactactgccagtcgtcgaagatgttcggcggagggactaagctgaccgtctaggtcagcccaagcncgccccctggtcactctcgttccccaccctcncgaactatagtagtcgtgagcgggtctgggacaagggccgcatagnnngcangcgntnnnnnnnnnnnnnnnnnnnnnnnnnnnnnnnnnnnnnnnnnnnnnnnnnnnnnnnnnnnnnnnnnnnnnnnnn

SEQ ID NO: 264155 - DNA, 696 bp, Homo sapiens
  misc_feature: GYAE6OF01CJ1F0.24.53.E09.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (579)..(579): a, c, t, g, unknown or other
  misc_feature (579)..(579): n is a, c, g, or t
  modified_base (597)..(597): a, c, t, g, unknown or other
  misc_feature (597)..(597): n is a, c, g, or t
  modified_base (659)..(659): a, c, t, g, unknown or other
  misc_feature (659)..(659): n is a, c, g, or t
  modified_base (691)..(691): a, c, t, g, unknown or other
  misc_feature (691)..(691): n is a, c, g, or t
tcagactactatgtcacgaccggtgctcgatttagagagagtgtgttgggttgggggctgttttggaagctgcttgtaccaggagggtcaccagtctcctgcacgtgggagacaacagtcggcgtctagggtttgatcgtcctacgtaggtacaaggcagtaccttaaccaaaaccgaccgaccccctaactccctatattactacgtaacaacactccggcctgtcgggtcctgacctctcnccnctacagtcgtgccnctcacgctcgcgcgccatcagtcggcacgtgctaggagcgtgacggtctacgtactgtacgcgtacggtacgtacgtaagttgtacgggtcgggacgggtaaacgtacacggccgttaccggtaacccgttaggagaccggtaccggaaccgtcggtcccgttcccccggacccgtttcggtaacccttcttccccgggttaccctacccccctacgtacccgttacggaactttaaccgggttacgtacccggttacgtacgggggttacggccgggttaacgacgggtaaccggtacggggacctagttaaaccggngacacgtcgacgttacgngtcgacgtacgacgtacgtacgtacgtacgtacgtacgtacgtacgacgtacgacgacgcgngtctacgactacgactacgtacgagtacgtgngtacg

SEQ ID NO: 264156 - DNA, 754 bp, Homo sapiens
  misc_feature: GYAE6OF01DUYXC.24.53.E09.1.454.CMB.1.raw
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
  modified_base (604)..(604): a, c, t, g, unknown or other
  misc_feature (604)..(604): n is a, c, g, or t
tcagactactatgtcacgaccggtgctcgatttagagagagtgtgttgggtttggaggtctcagagaggagccttagccctggagtccaaggtcctttccacttggtgatcagcactgagcacaggagactacaccagtggaagttgggctgagtcgttgggttttccttgttgtnttattttagaaggtgtcagtgtgaggtgctaagtgggtggtaggtcggtagggggngtcgttcgggtcctacggtccggtcgggggtcctaggtacgtccttctcgtgtcgctacgtccttcgttacggttaccttttaccccgtttagtcgttacgttttggacgtcgtccggtcggtcccgacgtacggccgtacgggacgggggcggtcgtagggtggtgggtacgtactaaagtaacgacggacaacggtagtaggtacgtaagtcgttaagtcgtaacgtagtcggtacggtcttacggtagggtaccggaaacggtccgttacttaaccgactccgttaccgaccgtaaacggacaacccgacccgtaccaagtaacctgtaccgttagttaacgtcgtaaacggtaactaccggaacgtanaccggttaggacggtaacgtcgggaaacggtccgtacggtaccgtttaagttacgttaaccggttacgtaccgggttaccgtaaccgttaaccctaataacccgtaacgaacggttaacccggtcggtaagggtcttcgaccgttaaccg

SEQ ID NO: 264157 - DNA, 333 bp, Homo sapiens
  misc_feature: GYAE6OF01ASCYX.24.53.E09.1.454.CMB.1.raw
  modified_base (107)..(107): a, c, t, g, unknown or other
  misc_feature (107)..(107): n is a, c, g, or t
  modified_base (180)..(180): a, c, t, g, unknown or other
  misc_feature (180)..(180): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (298)..(301): a, c, t, g, unknown or other
  misc_feature (298)..(301): n is a, c, g, or t
  modified_base (303)..(333): a, c, t, g, unknown or other
  misc_feature (303)..(333): n is a, c, g, or t
tcagactactatgtcacgaccggtgctcgatttagagagagtgtgttgggtttgggggggtgtggtggtctccactcccgccttgacggggctgctatctgccctcncgtggccatcactgggctccaggctggaggatggagggtgattactactgccagtcgtacgaagatgttcggngggaggactacgctcgaccgtcgtaggtccacgacccaaggcctcgaccccccgtggtccactccgtcgtccccaacccttccaccactatagtagtctgnggcgcngacgagcanannnncnnnnnnnnnnnnnnnnnnnnnnnnnnnnnnn

SEQ ID NO: 264158 - DNA, 662 bp, Homo sapiens
  misc_feature: GYAE6OF01CUF9M.24.53.E09.1.454.CMB.1.raw
  modified_base (167)..(167): a, c, t, g, unknown or other
  misc_feature (167)..(167): n is a, c, g, or t
  modified_base (591)..(591): a, c, t, g, unknown or other
  misc_feature (591)..(591): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (630)..(631): a, c, t, g, unknown or other
  misc_feature (630)..(631): n is a, c, g, or t
  modified_base (633)..(662): a, c, t, g, unknown or other
  misc_feature (633)..(662): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcgtaggttttgatgtccacgtggtacaagcagcttaaccaaaaacncgacccccaaactcctctatttatctaacaacaagtccgccctcgttcggggtccctggaccgtattcctcccgacctccgaaagtcgtcggcctacctccgacgccctcgcgtcggcctattcacgtcgggcctccgaggtcgtaggagggtatcgggtaaggggttcgaactttaccgtaacctcggtacccgtacggttaccggtacggaaaagttacggttccggttttaccgggggacgggaacggggtaacgtaacgtccggtacggaacccgttccggtacggtccaccggacccaaacgggtcctaccccgtcccccggtttcgtcctaccgttcccttcccgggtttcccccacccccttccgtacctaaccgtagttaacggttacgttccggttcgggaccggggtaccgggnggtaccgggaaccgtaggggccacggacttagngancgnngnnnnnnnnnnnnnnnnnnnnnnnnnnnnnn

SEQ ID NO: 264159 - DNA, 618 bp, Homo sapiens
  misc_feature: GYAE6OF01C7RNS.24.53.E09.1.454.CMB.1.raw
  modified_base (604)..(607): a, c, t, g, unknown or other
  misc_feature (604)..(607): n is a, c, g, or t
  modified_base (609)..(618): a, c, t, g, unknown or other
  misc_feature (609)..(618): n is a, c, g, or t
tcagactactatgtcacgaccggtgctcgatttagagagagtgtgttgggttggggctgttttggagctgcttgtaccagaggtcaccatctcctgcacgtgggagacaacatcggcgcgtaggttttgatgtccacgtaggtacaaagcagtaccttaacccaaaaaaccaccgaccccccaaaactccctactaattttaactacgtaaacaaactaactccggcccgtcgtcgggtccctacgaccgtacttcctccgtcctaccgaacgtcctcggccacctcacgcctcgcgtcgccatccgacgtcggcctcgaggctaggaggtagtgggtaggtactacttactacgtcgaccgtacggtacggtacggtaaaggttacggttcgggtccggggacgggtaacgggtaacgtaacggccgtaccggtaacccggtaccggtacggacgaccggaacccgaacggtcccgtcccggtacccccgttcggtaccctaccgttcccgttccccggttaccccctcccctctaccacgtagttacgttacggtcgtacggacgggtcgggtacgtcggaacgacgggcctaactaggtannnngnnnnnnnnnn

SEQ ID NO: 264160 - DNA, 750 bp, Homo sapiens
  misc_feature: GYAE6OF01BG2DE.24.53.E09.1.454.CMB.1.raw
  modified_base (242)..(242): a, c, t, g, unknown or other
  misc_feature (242)..(242): n is a, c, g, or t
  modified_base (319)..(319): a, c, t, g, unknown or other
  misc_feature (319)..(319): n is a, c, g, or t
tcagactactatgtcacgaccggtgctcgatttagagagagtgtgttgggtttgggaggcttggtccagccgtggggggtccctgagactctcctgtgcagcctctggacttcccctttagtgtacttttggatgaccgtgggtccgccaggctccgaggggcgggctggagtgggtcgacaatataaggcagatcggacgtagcatgtactagtgtcgactctagtgaaggccattcaccntcaccagacgacacgccagaactcactgtactcgtagaatacgaccacgcgtagaggacgtacggacggacgacgtntagtgttacttacgtgtcgacgaacctatacgtcgacgaccgtacggtaggtacgtccgactacgttcgtaactaaacttcccgtacaacggtactacgggttaccgggaccgtacggacccgttacccggttcggtaccctacccggttccctacccgttacgacccgtaccccgtaccgaaacccggacccggtaccctaccggtttcccccggttaccccgttcccccggtaccgggtccccgtcccgttacccggcccgtacccgtaacgggtcccgtacccgtaacccgtaccgggaaccgaccgaccgaacccggaccgggtccccggccgggtacggtccgtcccgggtacccgttcgggtaaacgtaacccgtaacccgttacccgttaccaacgttacggtaacggttcccgtggtaccggg

SEQ ID NO: 264161 - DNA, 609 bp, Homo sapiens
  misc_feature: GYAE6OF01EU8CG.24.53.E09.1.454.CMB.1.raw
  modified_base (112)..(112): a, c, t, g, unknown or other
  misc_feature (112)..(112): n is a, c, g, or t
  modified_base (251)..(251): a, c, t, g, unknown or other
  misc_feature (251)..(251): n is a, c, g, or t
  modified_base (552)..(553): a, c, t, g, unknown or other
  misc_feature (552)..(553): n is a, c, g, or t
  modified_base (557)..(558): a, c, t, g, unknown or other
  misc_feature (557)..(558): n is a, c, g, or t
  modified_base (560)..(609): a, c, t, g, unknown or other
  misc_feature (560)..(609): n is a, c, g, or t
tcagactactatgtcacgaccggtgctcgatttagagagagtgtgttgggtttggtagcaacatcggcgcaggtttttgatgtccactggtacaagcagcttccaaaaaacngccccccaaactcctcatttatcgtaaacaacaatccggccctcgtgggggtccctgaccgtattctcccgcctccaagtctggccacctcagcctcgctggccatcacgtgggcctccaggctgaggatggagggttnattaccactgcctaggtccgtacgaagtagttcggttcgggacgggaagggtaaccttaaaggccgttacggaacccggttccgttaacggggtaccaaccggtacccccgaaagggtccccgtccccgggtaccccccccgttacggggttaccctaacccgttccctttaccccggtttccccccctaacccccgtttcccctaccaaaccggttaacgtttacgggttaacgttcccggttagggaccggggtccggggtcggttacgggaaccgaacggggcctaccgagttagctnncgtnntnnnnnnnnnnnnnnnnnnnnnnnnnnnnnnnnnnnnnnnnnnnnnnnnnn

SEQ ID NO: 264162 - DNA, 753 bp, Homo sapiens
  misc_feature: GYAE6OF01CQ7WY.24.53.E09.1.454.CMB.1.raw
  modified_base (694)..(694): a, c, t, g, unknown or other
  misc_feature (694)..(694): n is a, c, g, or t
  modified_base (699)..(700): a, c, t, g, unknown or other
  misc_feature (699)..(700): n is a, c, g, or t
  modified_base (704)..(704): a, c, t, g, unknown or other
  misc_feature (704)..(704): n is a, c, g, or t
  modified_base (708)..(708): a, c, t, g, unknown or other
  misc_feature (708)..(708): n is a, c, g, or t
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (728)..(730): a, c, t, g, unknown or other
  misc_feature (728)..(730): n is a, c, g, or t
  modified_base (733)..(733): a, c, t, g, unknown or other
  misc_feature (733)..(733): n is a, c, g, or t
  modified_base (736)..(737): a, c, t, g, unknown or other
  misc_feature (736)..(737): n is a, c, g, or t
  modified_base (739)..(740): a, c, t, g, unknown or other
  misc_feature (739)..(740): n is a, c, g, or t
  modified_base (744)..(744): a, c, t, g, unknown or other
  misc_feature (744)..(744): n is a, c, g, or t
  modified_base (746)..(751): a, c, t, g, unknown or other
  misc_feature (746)..(751): n is a, c, g, or t
  modified_base (753)..(753): a, c, t, g, unknown or other
  misc_feature (753)..(753): n is a, c, g, or t
tcagactactatgtcacgaccggtgctcgatttagagagagtgtgttgggtttggggctgttttggaagctgcttgtaccagaggtcacatctcctgcactgggagcaacatcggcgcgtaggttttgactgtaccacgtaggtaacaagccagtaccttaaaccaaaaacgaccgtaacccccaaaacttccgtacttaatttaactaaccgtaaacaaactaacgtccggtaccccgtcggttacggggtaccccctaggtaaccgtatttccccgtaccgtaccccttacgaaacgttccgtacggaccttacccgtaacgccggtcccttcggcgttcggaccctagttaccgaccggttcgggtaccacccggaaggttccgaaggaaggtacggttaagggaggttacgttaactttaccgacgttacggaccgtaacggtacgtaaccgaggtagttcggggaccgggacggtaaggtaaccgtaagccgttaacgccggttaactacggtaccgaacggaccccggtaaggtcccctaaccccggtcccgtttaccggtacctacccgtttacccgttttacccgcccccccgttatacccccgtaaataaccgggtacgttaacggtacgttacggaaccgggacgggtcggttcgaaccgtaacgggaacggacgttacgtaancgganngagnagcngtanagntananangagcgnnngancgnnannagancnnnnnntn

SEQ ID NO: 264163 - DNA, 325 bp, Homo sapiens
  misc_feature: GYAE6OF01DC39N.24.53.E09.1.454.CMB.1.raw
  modified_base (282)..(325): a, c, t, g, unknown or other
  misc_feature (282)..(325): n is a, c, g, or t
tcagactactatgtcacgaccggtgctcgatttagagagagtgtgttgggtttggggggtgtggtggtctccactcccgccttgacgggctgctatctgcctcgctggccatcactgggctccagctgaggatgagggtgattactactgccagtcgtcgaagactgttcggcggagggactaagctgaccgtcctaggtcacgccaaggctcgccccctggcactctcgtcccaccctcctcacatagtagtctgaggcggctaggcaaggcgactagagnnnnnnnnnnnnnnnnnnnnnnnnnnnnnnnnnnnnnnnnnnnn

SEQ ID NO: 264164 - DNA, 587 bp, Homo sapiens
  misc_feature: GYAE6OF01AJGNP.24.53.E09.1.454.CMB.1.raw
  modified_base (163)..(163): a, c, t, g, unknown or other
  misc_feature (163)..(163): n is a, c, g, or t
  modified_base (345)..(345): a, c, t, g, unknown or other
  misc_feature (345)..(345): n is a, c, g, or t
  modified_base (552)..(552): a, c, t, g, unknown or other
  misc_feature (552)..(552): n is a, c, g, or t
  modified_base (554)..(556): a, c, t, g, unknown or other
  misc_feature (554)..(556): n is a, c, g, or t
  modified_base (559)..(560): a, c, t, g, unknown or other
  misc_feature (559)..(560): n is a, c, g, or t
  modified_base (562)..(587): a, c, t, g, unknown or other
  misc_feature (562)..(587): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgaccccccaaactcctcatttatccgtaaacaacaatccggccctcgtggggtcccctgacccgtattcctcccgccctccaagtcctggccacctcacgcctcgctcggccatccacgtgggcctccgaggcctggaggatggagggttgattacctactcgcctaggtccgtagaagtnttgggttcggcgggagggacctaaggcctacggaccgttccgtaggtccacggccccaagggtcctcccggccccccgtttcggtcctacgttccctttcccggttaccccccgccccttcccctaccgtaaccttagttacggttacgttccgtgggtaccgggcccggggtcgtacgggtaccgaaccgggcgaccgtagtacgncnnncgnncnnnnnnnnnnnnnnnnnnnnnnnnnn

SEQ ID NO: 264165 - DNA, 390 bp, Homo sapiens
  misc_feature: GYAE6OF01B4ODP.24.53.E09.1.454.CMB.1.raw
  modified_base (144)..(144): a, c, t, g, unknown or other
  misc_feature (144)..(144): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (351)..(390): a, c, t, g, unknown or other
  misc_feature (351)..(390): n is a, c, g, or t
tcagactactatgtcacgaccggtgctcgatttagagagagtgtggttgggtttgggggtgtggtgtctccactcccgccttgacggggctgctatctgcctcgcgtggccatcacgtgggctccaggctgaggatggagggtntattactactcgccagtcggtacgaagtattggttcgggacggtaggggaactaagcgtgacccgttcgtaggtcacggacccaaggcctcccggcccccgttcggtcctaccgttccgtccgtttcccccgcccttacctactaactagttacggtacgtcgtagggacggcgggtaccgngggacgaacggcggttanaagtgcnnnnnnnnnnnnnnnnnnnnnnnnnnnnnnnnnnnnnnnn

SEQ ID NO: 264166 - DNA, 393 bp, Homo sapiens
  misc_feature: GYAE6OF01DO6H0.24.53.E09.1.454.CMB.1.raw
  modified_base (145)..(145): a, c, t, g, unknown or other
  misc_feature (145)..(145): n is a, c, g, or t
  modified_base (172)..(172): a, c, t, g, unknown or other
  misc_feature (172)..(172): n is a, c, g, or t
  modified_base (181)..(181): a, c, t, g, unknown or other
  misc_feature (181)..(181): n is a, c, g, or t
  modified_base (311)..(312): a, c, t, g, unknown or other
  misc_feature (311)..(312): n is a, c, g, or t
  modified_base (314)..(314): a, c, t, g, unknown or other
  misc_feature (314)..(314): n is a, c, g, or t
  modified_base (316)..(393): a, c, t, g, unknown or other
  misc_feature (316)..(393): n is a, c, g, or t
tcagactactatgtcacgaccggtgctcgatttagagagagtgtgttggggtttgggggggtgtggtggtctccactcccgccttgacggggctgctatctgcctcgctggccatcactgggctccaggctgaggatggagggtnatttactactgccagtcgtcgaaagtntggttcggnggagggactaagctgacccgtctaggtcacgcccaaggcctccgcccccgtgctacctcttccgttcccccaccctctacactatacggtacgtctggacggcggcgtacggacgaaggccagtagtganncntnnnnnnnnnnnnnnnnnnnnnnnnnnnnnnnnnnnnnnnnnnnnnnnnnnnnnnnnnnnnnnnnnnnnnnnnnnnnnn

SEQ ID NO: 264167 - DNA, 769 bp, Homo sapiens
  misc_feature: GYAE6OF01CZQS7.24.53.E09.1.454.CMB.1.raw
  modified_base (106)..(106): a, c, t, g, unknown or other
  misc_feature (106)..(106): n is a, c, g, or t
  modified_base (268)..(268): a, c, t, g, unknown or other
  misc_feature (268)..(268): n is a, c, g, or t
tcagactactatgtcacgaccggtgctcgatttagagagagtgtggttgggtttgggaggcttggtccagccgtggggggtccctgagactctcctgtgcagcctntggtactttcccctttagtgtacttttggatgaccgtgggtccgccaggcctccgaggggcgggctgggaggtgggtcgaccaatagtaaggcacgtagtggacgttagctagtgtactagtcggtggacctgtaggacggaacgggccgtattccaacctntcctaccgagaagacccaaccgcccaagtaacctctacgtggtacttcgaaggaaaactcgaaccaggtcctaggaacggacggtacggaaacgggtaaccgtacggtacttattaacggttaactttaccggtcggttaccggaacctacctaaacggttcacgacgacccgtaccgttagggaccgttcgaacttactccgaagtaaacctttaccgtacccgaagttacgtaaccgggttccgggaaccggtacggtacccctacccgtccgtaccgtaccggtccctacctaccgacccgtacccgtacccgaacccgaaccgggtccctaccggtcccgttcccctcccggtccgcccgtccgtccgcccgtccgaacgtccgacccgtacccgtacgacgtaccgactccgtacggcccggtccgtcggccgtccggaccggtcggtacccgaacgtaccgttaccctacgtaacacgtacggtgtagtaccggg

SEQ ID NO: 264168 - DNA, 638 bp, Homo sapiens
  misc_feature: GYAE6OF01B7MET.24.53.E09.1.454.CMB.1.raw
  modified_base (147)..(147): a, c, t, g, unknown or other
  misc_feature (147)..(147): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (589)..(589): a, c, t, g, unknown or other
  misc_feature (589)..(589): n is a, c, g, or t
  modified_base (594)..(595): a, c, t, g, unknown or other
  misc_feature (594)..(595): n is a, c, g, or t
  modified_base (597)..(598): a, c, t, g, unknown or other
  misc_feature (597)..(598): n is a, c, g, or t
  modified_base (602)..(602): a, c, t, g, unknown or other
  misc_feature (602)..(602): n is a, c, g, or t
  modified_base (608)..(609): a, c, t, g, unknown or other
  misc_feature (608)..(609): n is a, c, g, or t
  modified_base (611)..(615): a, c, t, g, unknown or other
  misc_feature (611)..(615): n is a, c, g, or t
  modified_base (617)..(620): a, c, t, g, unknown or other
  misc_feature (617)..(620): n is a, c, g, or t
  modified_base (622)..(622): a, c, t, g, unknown or other
  misc_feature (622)..(622): n is a, c, g, or t
  modified_base (624)..(629): a, c, t, g, unknown or other
  misc_feature (624)..(629): n is a, c, g, or t
  modified_base (631)..(634): a, c, t, g, unknown or other
  misc_feature (631)..(634): n is a, c, g, or t
  modified_base (636)..(638): a, c, t, g, unknown or other
  misc_feature (636)..(638): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaancagcttaccaaaaacacgacccccctaaaatccttcactttatacgtaaacaacaatccggccctcgtcggggtccctgaccgnttcctccgcctaccaagtctggcacctcncgcctcgctcggccacgtcacgtcgggcctaccgaggtcctggaggtatgggaagggttcaactttaccgacgtcggacctaacggttccgtaacggtaagtaacgttcgggttccgggacggggaagggtaacctaaggacgtcggaccccgttaccggttacggccacggaccccgaacggtccctcccggtcccccttacggtaccctaccgtttccgttccccgtttccccccgcctttacccgtacctaaccgtactttacggtaccgtcggttacggtcgggcccgggtgttacgggaccgaagggcccgtacggtaatcgtngaccnncnncganactcgnncnnnnncnnnncncnnnnnncnnnncnnn

SEQ ID NO: 264169 - DNA, 786 bp, Homo sapiens
  misc_feature: GYAE6OF01ARNHO.24.53.E09.1.454.CMB.1.raw
tcagactactatgtcacgaccggtgctcgatttagagagagtgtgttgggtttggggacggcttggtccagcctggggggtccctgagactctcctgtcgcacgcctctggacttcccctttagtgtacttttggatgacctgggtccgccaggctccgagggcgggctggagtgggtgccaatataggcagatggactagcatgtactatggtcgactctggtacggaacggtccgtattccgacctacgttcctacccgaaggaaccgaacctaaaccggcccctaaagtaaccctacacgttgtaatcgtaacgggaaaattcgaacctacgcctaggacgtaacggtcgaacggacaaccggtctaagttagtaacgtttacctggtcgaccgaacctatagtacacgtccgtaccgtggaactcgtacattccgtaagaaacttccgttacacgacgttacggttacggggaacccgaccgggaccgttacccggtcgggttaccctacccgttaccgttccccttaccgaccggttaccccgtacccgtaaaccggtaaccgggccccttacggttccccgtcccgtttacccccggtcgggccttccccgtcgacccgttaaccgaccggggaaccctcccggtaaccccgtccggtaaccggtaccgacgtaaacccggcggtaaccccggccggttcggggcctttcccggcggttaccggtacaaaccggttcgtaaccccttaacgaccgtaattacgggtcgtcggtaacgggg

SEQ ID NO: 264170 - DNA, 708 bp, Homo sapiens
  misc_feature: GYAE6OF01A8TQI.24.53.E09.1.454.CMB.1.raw
  modified_base (236)..(236): a, c, t, g, unknown or other
  misc_feature (236)..(236): n is a, c, g, or t
  modified_base (608)..(608): a, c, t, g, unknown or other
  misc_feature (608)..(608): n is a, c, g, or t
  modified_base (626)..(626): a, c, t, g, unknown or other
  misc_feature (626)..(626): n is a, c, g, or t
  modified_base (642)..(642): a, c, t, g, unknown or other
  misc_feature (642)..(642): n is a, c, g, or t
  modified_base (659)..(659): a, c, t, g, unknown or other
  misc_feature (659)..(659): n is a, c, g, or t
  modified_base (673)..(673): a, c, t, g, unknown or other
  misc_feature (673)..(673): n is a, c, g, or t
tcagactactatgtcacgaccggtgctcgatttagagagagtgtgttgggtttggggctgttttggagctgcttgtaccagagggtcaccatctcctgcactgggagcaacatcggcgctaggttttgatgtccactggtacaagcagcttaccaaaaacacgacccccaaactcctactatttataccgtaaacaacaatccggaccctcgtcggggtccctagaccgtattccnccgacctcaagtctgcacctcacgcctcgctacggccctatccgacgtcgggcctaccgaggtcctaggaacggtatggagggttatactttaccgtacgtcgaccgtaaggtccgtacggaaagtcgtcggttaccggcgggaaaggctaagcgtaccgtaccgtaccgttacgggtaccacgaccgaacggtccgtacccggtcccccgtacggtccttaaccctttcccgtttaccccggtacccccctaacccggttacccttaaccgtaacgtaacgtttaaccggttacggttacccgttaggggtaccgggtcccggggtacgttaccggggaacgtaaccggtacggttaccaaggttaaccgngttacatgtacactacgntaccgatgaccttagntacctaggcacgtaccncgactacgtactanctgacgacgacgtacgtacgtagcgtacgtcgtac

SEQ ID NO: 264171 - DNA, 457 bp, Homo sapiens
  misc_feature: GYAE6OF01BXX71.24.53.E09.1.454.CMB.1.raw
  modified_base (413)..(413): a, c, t, g, unknown or other
  misc_feature (413)..(413): n is a, c, g, or t
  modified_base (433)..(457): a, c, t, g, unknown or other
  misc_feature (433)..(457): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaatcctcatttatcgtaacaacaatcggccctctggggtccctgaccgattcctccgcctccaagtctggcacctcagcctcgctggccatcacgtggctccaggctgaggatggagggtgattacactgccagtcgtcgaagatgttcggcggagggactaagctgaccgtcctaggtccagcccaaggctcgccccctggtcactctcgttcccgcctctcacatagagtctgagccgggntggacaaggcgacatacggnnnnnnnnnnnnnnnnnnnnnnnnn

SEQ ID NO: 264172 - DNA, 803 bp, Homo sapiens
  misc_feature: GYAE6OF01BMRRC.24.53.E09.1.454.CMB.1.raw
  modified_base (437)..(437): a, c, t, g, unknown or other
  misc_feature (437)..(437): n is a, c, g, or t
tcagactactatgtcacgaccggtgctcgatttagagagagtgtgttgggtttgggaggcttggtccagcctgggggggtccctgagactctcctgtgcagcctctggactttcccctttagtgtactttttggatgaccgtcgggtccgacccaggcctccgaagggggacggggctgggaggtggggtcggaccaaattaataaacgggcaacgagtgggaccgtagactatcgtactagtggtggaacttcgtaggtaggaacgggcctaattccaaccagtcctaccaggaactaaccaaccgtacccaagaaacctcaacgtataagtcgaggaaatgaacccagcctagaggtacgcggaacggaccgagtactagttacgtattcgtagcggaccaactatactacgaagaccgtaacggaggggtaacnccgtatacgtacctaagtaaacctaccgttacacgtaggtacgggttcgggaacgaccggtacctaccgttaggtacccctaccttccgttaccactaacccggacccttacccgaaacccggggtaacccggacccgttaccccggttttaccggtccccccgttacccccggtacgggtcccccgtcccggtaccgcccctaaccgggtaaccggaccgtaccctaccccggttaaccgaacgtaccggaccgaacgtacccggccggtcccggtaccggtgccggtacccgtaacggtaacccgtaacggttaccgttaccctaacggtaaccttaagggttaacccttggtaccgtacgggg

SEQ ID NO: 264173 - DNA, 733 bp, Homo sapiens
  misc_feature: GYAE6OF01EU4MN.24.53.E09.1.454.CMB.1.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (701)..(701): a, c, t, g, unknown or other
  misc_feature (701)..(701): n is a, c, g, or t
  modified_base (709)..(709): a, c, t, g, unknown or other
  misc_feature (709)..(709): n is a, c, g, or t
  modified_base (711)..(712): a, c, t, g, unknown or other
  misc_feature (711)..(712): n is a, c, g, or t
  modified_base (715)..(715): a, c, t, g, unknown or other
  misc_feature (715)..(715): n is a, c, g, or t
  modified_base (717)..(718): a, c, t, g, unknown or other
  misc_feature (717)..(718): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
tcagactactatgtcacgaccggtgctcgatttagagagagtgtgttgggtttgggggctgtttttggaagctgcttgtaccagagggtcaccatctcctgcacgtgggagcaacattccggcgctaggttttgatgtccactggtacagcagcttaccaaaacncgaccccaaactcctntatttacacgtaacaacagtcggcctcgtcgggtcccngaccgtattccncccgacctacctaacgttcgtcggacctaacccctcgaccgtccctcgtacgttcggacctactcctaaccggttacgggaccgttacccgaagggtccgtaggaacgggtagttacgggacggggttactaacctttaaccgtaaccgttcgtaccgtacggttaccggttacggtaaacgtacggtttcgggttaccggggaacggggtaacgggtaaccgttaacggtaccgtaccggttaccccggtaccggttacggtaccgaaccggtacccggaacggccttacccggccccgttccgggtaacccttcgtccgtttacccgtacccctaccccgttacctacctaaccgtacgtttaacggtacgttaccggtcggaacgggtcccgggttacgtaccgggacgaacgggaccgtactaaggtcgagtctatcgnttcntagngnatncnctcgtctcgcgntacgacgngnngcnannacgtgncgcntcgng

SEQ ID NO: 264174 - DNA, 314 bp, Homo sapiens
  misc_feature: GYAE6OF01DRV2N.24.53.E09.1.454.CMB.1.raw
  modified_base (291)..(314): a, c, t, g, unknown or other
  misc_feature (291)..(314): n is a, c, g, or t
tcagactactatgtcacgaccggtgctcgatttagagagagtgtgttggggttggggggtgtggtggtctccactcccgccttggacgggctgctactctgcctcgctggccatcactggctccaggctgaggatgaggtgattactactgccagtcgtcgaagatgttcggcggagggactaagctgaccggtcaggtcacgcccaaggctcgcccctggtccacgtctacgttcccaccctcctcacgtatagtagtctgacgacgggctggccaaggcgtccataggnnnnnnnnnnnnnnnnnnnnnnnn

SEQ ID NO: 264175 - DNA, 998 bp, Homo sapiens
  misc_feature: GYAE6OF01EOL7G.24.53.E09.1.454.CMB.1.raw
  modified_base (822)..(822): a, c, t, g, unknown or other
  misc_feature (822)..(822): n is a, c, g, or t
  modified_base (983)..(983): a, c, t, g, unknown or other
  misc_feature (983)..(983): n is a, c, g, or t
tcagactactatgtcacgaccggtgctcgatttagagagagtgtggttgggtttgggaggcttggtccagcctggggggtccctgagactctcctgtgcagcctctggtacttccctttagtgtacttttggatgacctgggtccgaccaggctccggaggggacgggtctggaaggtgggtgaccaatagtaaggcaacgatcggacgttagctagttagtactagtcggtggtaccttcgtagggttagggaaacggggtcccgtaattccgaacctacttccgaccgaaaggacgaaacccgtaaacccggaccccgaaagtaaaccgtctaacgttaggttaacttacggtaaacgggtaaaaatcccggaaacccgtacggtcctaagggtaacggtacggtaacccgggaagggtaaaccccgaaccggggttctttaaggttacgttttaacgtttaaccggtgggtaccggaacccgtaaaccgttacttaacttacggaaccgtacccgtaaccggttcggggtaaacggtccgaacgttacgtttaactacggttaaaacctttacccggttaccgaacgggttaccgttaacgggggttccccggggaaacccggacccgggttacccgtaacccgggtttacggtccccttaaacccgggttcccttaccccgtaaccgtacccggtccccgtaaaccccggtaaacccgggtaaccccgggtaccctttaccgggtttccccggttacccccctttccccgggtcggtcccccgtccccgttaccgccgttaacccggaacggggtccnccccggtaacccggttaccgggacgacggaaccccgacggtaccggggtaccccgggttccggtaccgggttcccgtaccggttaccgggttacggtaaaccggtaacccgggttcccttaaacccggttaacccgtaacggttaggtaaccggtttccgngggttaacccggggg

SEQ ID NO: 264176 - DNA, 662 bp, Homo sapiens
  misc_feature: GYAE6OF01EV3QG.24.53.E09.1.454.CMB.1.raw
  modified_base (172)..(172): a, c, t, g, unknown or other
  misc_feature (172)..(172): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (561)..(561): a, c, t, g, unknown or other
  misc_feature (561)..(561): n is a, c, g, or t
  modified_base (590)..(590): a, c, t, g, unknown or other
  misc_feature (590)..(590): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (632)..(650): a, c, t, g, unknown or other
  misc_feature (632)..(650): n is a, c, g, or t
  modified_base (652)..(655): a, c, t, g, unknown or other
  misc_feature (652)..(655): n is a, c, g, or t
  modified_base (657)..(662): a, c, t, g, unknown or other
  misc_feature (657)..(662): n is a, c, g, or t
tcagactactatgtcacgaccggtgctcgattttagagagagtgtgttgggtttgggggctgtttttggaagctgcttgtaccaggagggtcaccatcctcctgcacgtgggagcaacatcggcgctaggttttgatcgtccactggtacaagcagtccttaccaaaaaacnccgacccccaaactcctactagttttanccgtaaacaacaacgtcccgccttcgtcgggtccctgaccgtacttcncccgcctaccaagtctcgccctacctcacgtccccgtanccgttcggaccagttccacggtggaccctccgaggtccgtaggaagtagttcggggaggtttaacgattttaccacgtacggtccgtacgttaaccggtacgtaaaggtgtttcggggaaccgggacggtaacgggtaagtaccggtaccgtacggtaccccggtttacccgaaggcccgaaacccgccgtacggtccccgtcccgacccccggttggtaaccttcctccgtttcccccgtaccccttacccctacacgaaaccttgggttaancccggtttacgcggaccgggttaccgggngtaaaccgggacgtagccgtaactaaggcntacngtcngacnnnnnnnnnnnnnnnnnnncnnnncnnnnnn

SEQ ID NO: 264177 - DNA, 644 bp, Homo sapiens
  misc_feature: GYAE6OF01A7MUY.24.53.E09.1.454.CMB.1.raw
  modified_base (313)..(313): a, c, t, g, unknown or other
  misc_feature (313)..(313): n is a, c, g, or t
  modified_base (613)..(613): a, c, t, g, unknown or other
  misc_feature (613)..(613): n is a, c, g, or t
  modified_base (618)..(644): a, c, t, g, unknown or other
  misc_feature (618)..(644): n is a, c, g, or t
tcagactactatgtcacgaccggtgctcgatttagagagagtgtgttgggtttgggggctgtttttggaagctgcttgtaccagaggttcaccatctcctgcactgggagcaacatcggcgcaggttttgatgtccactggtacaagcagccttaccaaaaacagccccccaaactcctcatttatcgtaaacaaacaactcggccctcgtcggggtccctgaccgtacttcctcccgcctccaagtctggccacctcacgccctcgctcggaccatcacgtgggctcccgaggctggaggagtggaggggtntagtttaactcctcggccgtaggtccgtacgaaagtagttcgggtttccggggacgggtaggggaaaccgttaacggccgttacgggtaacccccggttcccgttaacgggttcccgaaccggcccccggaaacgggcccgttacccggccccccccgtttacgggtaccctaccttccccggtttcccggttccccccccgggtccccttccccgtacctaaccgtaacgtttaacggtaacggtttcccgtgggacgggcggggtccgttacgggacgaacggccggaactacgtagngcatnnnnnnnnnnnnnnnnnnnnnnnnnnn

SEQ ID NO: 264178 - DNA, 302 bp, Homo sapiens
  misc_feature: GYAE6OF01A7VHL.24.53.E09.1.454.CMB.1.raw
  modified_base (273)..(273): a, c, t, g, unknown or other
  misc_feature (273)..(273): n is a, c, g, or t
  modified_base (291)..(302): a, c, t, g, unknown or other
  misc_feature (291)..(302): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatggttcggcggagggactaagctgaccgtctaggtcagcccaaggctcgccccctggtcactctcgttccccaccctcctacacgtatagtagtctggacggcggcgnggacgaacggcactatannnnnnnnnnnn

SEQ ID NO: 264179 - DNA, 887 bp, Homo sapiens
  misc_feature: GYAE6OF01BHCMI.24.53.E09.1.454.CMB.1.raw
tcagactactatgtcacgaccggtgctcgatttagagagagtgtgttgggtttgggaggcttggtccagccgtggggggtccctgagactctcctgtgcagcctctggacttcccctttagtgtacttttggatgacctgggtccgccaggcctccgaggggacggggctgggaggtgggtggccaatagtaaggcacgatgggacgtagcatgtactatggtggacttcgtggtaggaacgggcctattccaacctattcctaccgaagacgaaccaaccggccctaagaacctcactgtactcgtaggaaatcgaaccagcctggagagtcggaggacacggtctagtgtacttagtggtcgacgtactagttactacacgccaccgtggacgtcgactctacgagtaacttaccgttacgacgtcgtaacgggttcgggggaccctaaccgggggtacccttaccccggttcgggttacccgtaaccccggtttcccgttaccccgttacccgaacccggttacccccgttaaccccggaaaccccgggtaaaccccggggtcccccttaaccgggtttcccccgggttttaccccccgtttacccccccgggtcgggtccccccgttaccccgttcccgggtacccgtacccgggtaaccgggtacccgacccgtaccccggttaacccggacgggtaacccgacccgaaccgggtaccggggtcccccgggtccccgggttaccgggggccccgtttaccggggttaccccggtttaccggggtaacccggtaaacccgggtttaaccccgtttaacccgttaaccccgaaacggtttaaaccggtttaccggttaacccgggtttccgggtaacccggggg

SEQ ID NO: 264180 - DNA, 698 bp, Homo sapiens
  misc_feature: GYAE6OF01EU550.24.53.E09.1.454.CMB.1.raw
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (649)..(649): a, c, t, g, unknown or other
  misc_feature (649)..(649): n is a, c, g, or t
tcagactactatgtcacgaccggtgctcgatttagagagagtgtgttgggtttggggggtgtggtggtctccactcccgccttggacggggctgctatctgcctcgctggccatcactgggctaccgaggcgtgaggtatggaggtcgtaattactactgaccaggttccgtacgaaagtagttcggttacgggacggaagggtaacttaagcttcggaccgtacgtacggtacaacgaccccgtaaaggtccttaccggccccccgttggttacctaacgttcccgttaccgttaccccccaaccccgttcctaccgaactaagttaacgtacggttacctcgggaacgggtcgggtaccgtacgggaaccgaacgggtaccgaacgtaagagactagtganganctgactgacgtacgngactagtcgagtacaggtacngacgtanatccggtagtacncncacgagtacgtatactactagtacacgtagtacgtagtacgtagtacgtagtacgacgacgtaagagtaacgaggtacgtacgtagtaacgtacgacgtagtagtaaccgtacgaacgacgaggacgtaccggtaagtacgtaacggtacgtacggtacggtacgtaacgtacaacgtaagtaanaactacagtacgtaagtacgttacggaacgtaaccgtagtaccgtaacg

SEQ ID NO: 264181 - DNA, 437 bp, Homo sapiens
  misc_feature: GYAE6OF01BRTKG.24.53.E09.1.454.CMB.1.raw
  modified_base (147)..(147): a, c, t, g, unknown or other
  misc_feature (147)..(147): n is a, c, g, or t
  modified_base (376)..(437): a, c, t, g, unknown or other
  misc_feature (376)..(437): n is a, c, g, or t
tcagactactatgtcacgaccggtgctcgatttagagagagtgtgttggggtttgggggggtatggtggtctccactcccgccttggacggggctgctatctgccctgctggccatcactgggctccaggctggaggatggagggtntaattacactggccagttcgacgaaagtgttggtccgggcgggaaggaactaaggctacggtaccgtaccgtaggccaacggacccgaaggtcccgtccccgtcccccggttggtactaccctttacccgttccccgttccccccaacccgtcctaactaacgttaggtttaacgtcggttacgtgggacggggccggtacgtacggaacggacggactaagagtgctnnnnnnnnnnnnnnnnnnnnnnnnnnnnnnnnnnnnnnnnnnnnnnnnnnnnnnnnnnnnnn

SEQ ID NO: 264182 - DNA, 663 bp, Homo sapiens
  misc_feature: GYAE6OF01CS7JO.24.53.E09.1.454.CMB.1.raw
  modified_base (139)..(139): a, c, t, g, unknown or other
  misc_feature (139)..(139): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (494)..(494): a, c, t, g, unknown or other
  misc_feature (494)..(494): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (611)..(612): a, c, t, g, unknown or other
  misc_feature (611)..(612): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (632)..(635): a, c, t, g, unknown or other
  misc_feature (632)..(635): n is a, c, g, or t
  modified_base (639)..(640): a, c, t, g, unknown or other
  misc_feature (639)..(640): n is a, c, g, or t
  modified_base (653)..(653): a, c, t, g, unknown or other
  misc_feature (653)..(653): n is a, c, g, or t
  modified_base (655)..(656): a, c, t, g, unknown or other
  misc_feature (655)..(656): n is a, c, g, or t
  modified_base (659)..(660): a, c, t, g, unknown or other
  misc_feature (659)..(660): n is a, c, g, or t
tcagactactatgtcacgaccggtgctcgatttagagagagtgtgttgggtttggggctgttttggagctgcttgaccagaggtcaccatctcctgcacgtggggatacaaacgcgtccgggacgtcgtaggtttttgntcggtccacggttggtaaccaagccgtaagtcccttaaacccgaaaaacaccggtacccccctaaaacttcctacttaattttaacgtaccgtaaaccaactaactccgggtcccttcgggtaccggggtaccctcgaccgttnttcccncccgacgttaccgaagttccgcggcctaaccgtcgacgccgtcgcgtcggactacttccgngtacggcctacgaggtctaggagtgtaggtacgntaactacgcagtacgacgtcgtagagtacgttcggtcgggaggacggtacacggtcgtaccgtaccgtggtaacgccgacgtaccgacggtctaccccggcctgttaccncttttacccgccctaacccgtccttacgtacaacggtttactaggttccgtcggtacggaccggtaccggtacggaccggtaagaccgtacggtcaacggtgcngacctnagnacgnngtnacgtntcactncacncnnnngtcnntcgcgacgacgcncnncgnngcg

SEQ ID NO: 264183 - DNA, 707 bp, Homo sapiens
  misc_feature: GYAE6OF01BAIFL.24.53.E09.1.454.CMB.1.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagactactatgtcacgaccggtgctcgatttagagagagtgtgttgggtttggggaggcttggtccagcctggggggtccctgagactctcctgtgcagcctctggacttcccctttagtgtactttttggatcgacctgggtccgccaggctccgaggggacggggctgggaggtgggtggaccaaatagtaaggcacgatggacgtagcatgtactatgtgactctgtgaaggccattccacatcncagagacaacgccagaactcatntatcgtagaatcgaccagtccgtagaagtacgtacgaaggaccacggtcttagtagttaattaacgtggtacgaccgaaccaattaactcgaacgtccgaaccgttggaacgtcgactaatctaagaacttaccgttaccagaccgtacgttcggggaccaacggggtcctacccgtacggtaccgacccgttcctccgtaccacgtacccgtaccaaccgaaccggtaccctacgttcccggtcccgttacccccgtcggtccccgacccgtccgtaccgtacccgtaacggacgtacccgtaacccgtacccggtaacgaccggaccgaccggaccgggacccggtcccggtacgggtacccgtcgtacccggtacggtacccgtaacggtaaccttacccgttaccaactaacgtagtaccgttcgtacgg

SEQ ID NO: 264184 - DNA, 350 bp, Homo sapiens
  misc_feature: GYAE6OF01AE850.24.53.E09.1.454.CMB.1.raw
  modified_base (308)..(350): a, c, t, g, unknown or other
  misc_feature (308)..(350): n is a, c, g, or t
tcagactactatgtcacgaccggtgctcgatttagagagagtgtgttggggtttgggggggtgtggtggtctccacctcccgccttgacggggctgctatctgcctcgctggccatcactgggctccgaggctgaggatggagggtagattactaactgccagtcgtacgaagtatggttcgggcggaagggactaagctaggaccgtcctaggtccacgcccgaaggctccggccccctcggcactctcgttccccaccctctacactatagtagtcgtgacggcggtcgaggacgacggcactagnnnnnnnnnnnnnnnnnnnnnnnnnnnnnnnnnnnnnnnnnnn

SEQ ID NO: 264185 - DNA, 681 bp, Homo sapiens
  misc_feature: GYAE6OF01CDLCS.24.53.E09.1.454.CMB.1.raw
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagcttgggttttccttgttgctattttagaaggtgtccagtgtgaggtgcaacgtggtggagtcgtggggggagtcgttggtccagccgtcggggggtccctggagtacctctcctgtcgcacgtcctcgtggtactttcccctttagtcgtacttttggattcgaccgttcgggcccgccgtacggcctccggacgggggaccggggcgtggggagggttggggtcggacccgaaagttaacgtaacgggcgaacggtacgtaggtacggtagctagtcgtaactagtggtcggacttcgtggtacggaacgggtccgtacgttccaacctactcccgtaccgaaggaacgaaccgaacccgacccgaacgtaacctcctaacgttcgtaactcgtaacggaaactccgaaccacgtcctaggacgtacggtacggacggaaccgacggtacttagtgttaacgttacgtggtaccgaccgtaactatacctacgaacgtacccgaccgttagggtaccgtcgtcgtaacg

SEQ ID NO: 264186 - DNA, 778 bp, Homo sapiens
  misc_feature: GYAE6OF01B1M2U.24.53.E09.1.454.CMB.1.raw
  modified_base (400)..(400): a, c, t, g, unknown or other
  misc_feature (400)..(400): n is a, c, g, or t
  modified_base (719)..(719): a, c, t, g, unknown or other
  misc_feature (719)..(719): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (731)..(731): a, c, t, g, unknown or other
  misc_feature (731)..(731): n is a, c, g, or t
  modified_base (733)..(734): a, c, t, g, unknown or other
  misc_feature (733)..(734): n is a, c, g, or t
  modified_base (740)..(740): a, c, t, g, unknown or other
  misc_feature (740)..(740): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (753)..(753): a, c, t, g, unknown or other
  misc_feature (753)..(753): n is a, c, g, or t
  modified_base (760)..(761): a, c, t, g, unknown or other
  misc_feature (760)..(761): n is a, c, g, or t
  modified_base (765)..(765): a, c, t, g, unknown or other
  misc_feature (765)..(765): n is a, c, g, or t
  modified_base (771)..(771): a, c, t, g, unknown or other
  misc_feature (771)..(771): n is a, c, g, or t
  modified_base (774)..(776): a, c, t, g, unknown or other
  misc_feature (774)..(776): n is a, c, g, or t
tcagactactatgtcacgaccggtgctcgatttagagagagtgtgttgggtttggggctgtttttggaagctgcttgtaccagagggtcaccatctcctgcacgtgggagcaacagtcggcgctagggtttttgattgtacccagttagggtaacaagcaggtacctttaaccaaaaaacgccgacccccctaaaacttcctactattttagtaactaaacaaacaatccggcccttcgtcggggttaccctgaccgtattcccgtccgacccttacaacgtcgtgccacctcacgcccttcgcgtggccactaccgacgttcggctccgaggcctagaaggagtgggtagggtattaaactttacccgtacgtcggtaaccgtaggtacccgggttaanaaacggtcgtttggggtaccggggacgggaaacggtaacgtacgggtcctaacccggtacgggtttacccttacgggtacccgaaccggtaccgtaaacccgggggtccctcccccgggtttaccccccgtacggggttttaaacctacccgttttccccggtttaccccgttaaccccccccttaaccccgttttacccgaaacttaaaccggttttacgttacggttaacgtcggtaacggggttccggggccgggtttaccgggacggtaaaccgggaaaccggtcccggtaagaaaccgggttgacgtgacgagngagtngacncanannacgacncgtntntactcgngcgtcanncacntcgatnagnnnga

SEQ ID NO: 264187 - DNA, 615 bp, Homo sapiens
  misc_feature: GYAE6OF01C6AUI.24.53.E09.1.454.CMB.1.raw
  modified_base (225)..(225): a, c, t, g, unknown or other
  misc_feature (225)..(225): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (605)..(605): a, c, t, g, unknown or other
  misc_feature (605)..(605): n is a, c, g, or t
tcagactactatgtcacgaccggtgctcgatttagagagagtgtgttgggtttgggaggcttggtccagccgtggggggtccctgagactctcctgtgcacgcctctggacttcccctttagtgtactttttggatgaccgtggtccgccaggcctccgagggacggggctgggagtgggtggaccaataagtaaggcacgagtggacgtagcatgtactatggngactgtgtgaacgggccattcacctatcctaccagagaccaaccgccaagaacctcactgtatcgagaaatcgaccagccngagngtcgaggacacggctatgtattacgtgtgcgaccagtactcacgccacgnggaacgtccgactagtctagaaacttaccgtcaagcgtaaggttcggggccaacgggtcctacccgtcggtcccacccggtcctccctcgaccgtcctacccgaaccgaccggaccctacgtcccggttacccctccccgtcggccctcccgtcgtccgacggcaccgcctacgagacgcacgccggccgccgtggcctcggccgtgaccgtaacgtacctaccgtacaacgttactagttacgngttcggacgg

SEQ ID NO: 264188 - DNA, 273 bp, Homo sapiens
  misc_feature: GYAE6OF02IYXKN.24.53.E09.1.454.CMB.1.raw
  modified_base (271)..(273): a, c, t, g, unknown or other
  misc_feature (271)..(273): n is a, c, g, or t
tcagactactatgtcacgaccggtgctcgatttagagagagtgtgttggttgggtgtggtggtctccactccgccttgacgggctgctatctgcctcgctggccatcactggctccaggctgaggatgaggtgattactactgccagtcgtcgaagatgttcggcggagggactaagctgaccgtcctaggtcagcccaaggctgcccctcggtcactctgttcccaccctcctcacatagtagtctgagcgggctggcaaggcgcatagnnn

SEQ ID NO: 264189 - DNA, 282 bp, Homo sapiens
  misc_feature: GYAE6OF02H1JAI.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnn

SEQ ID NO: 264190 - DNA, 278 bp, Homo sapiens
  misc_feature: GYAE6OF02IL1JC.24.53.E09.1.454.CMB.1.raw
  modified_base (278)..(278): a, c, t, g, unknown or other
  misc_feature (278)..(278): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttccccaccctcctcacatagtagtctgagcgggctggcaaggcgcatagn

SEQ ID NO: 264191 - DNA, 275 bp, Homo sapiens
  misc_feature: GYAE6OF02IH1QC.24.53.E09.1.454.CMB.1.raw
tcagactactatgtcacgaccggtgctcgatttagagagagtgtgttgggttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttcccaccctcctcacatagtagtctgagcgggctggcaaggcgcatag

SEQ ID NO: 264192 - DNA, 280 bp, Homo sapiens
  misc_feature: GYAE6OF02IQCJE.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnn

SEQ ID NO: 264193 - DNA, 278 bp, Homo sapiens
  misc_feature: GYAE6OF02FU7GI.24.53.E09.1.454.CMB.1.raw
  modified_base (276)..(278): a, c, t, g, unknown or other
  misc_feature (276)..(278): n is a, c, g, or t
tcagactactatgtcacgaccggtgctcgatttagagagagtgtgttgggtttgggtgtggtggtctccactcccgccttgacgggctgctatctgcctcgctggccatcactggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnn

SEQ ID NO: 264194 - DNA, 278 bp, Homo sapiens; identical to SEQ ID NO: 263545
  misc_feature: GYAE6OF02H8MU0.24.53.E09.1.454.CMB.1.raw
  modified_base (278)..(278): a, c, t, g, unknown or other
  misc_feature (278)..(278): n is a, c, g, or t

SEQ ID NO: 264195 - DNA, 279 bp, Homo sapiens
  misc_feature: GYAE6OF02IYCFP.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacataatagtctgagcgggctggcaaggcgcatagn

SEQ ID NO: 264196 - DNA, 280 bp, Homo sapiens; identical to SEQ ID NO: 263455
  misc_feature: GYAE6OF02GEVJK.24.53.E09.1.454.CMB.1.raw
  modified_base (278)..(280): a, c, t, g, unknown or other
  misc_feature (278)..(280): n is a, c, g, or t

SEQ ID NO: 264197 - DNA, 299 bp, Homo sapiens
  misc_feature: GYAE6OF02FXXFC.24.53.E09.1.454.CMB.1.raw
  modified_base (278)..(299): a, c, t, g, unknown or other
  misc_feature (278)..(299): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnnnnnnnnnnnnnnnnnnn

SEQ ID NO: 264198 - DNA, 280 bp, Homo sapiens
  misc_feature: GYAE6OF02GWJ94.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagn

SEQ ID NO: 264199 - DNA, 279 bp, Homo sapiens
  misc_feature: GYAE6OF02I3GA8.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagn

SEQ ID NO: 264200 - DNA, 434 bp, Homo sapiens
  misc_feature: GYAE6OF02G2QYM.24.53.E09.1.454.CMB.1.raw
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatgnnnnnnnnn

SEQ ID NO: 264201 - DNA, 280 bp, Homo sapiens
  misc_feature: GYAE6OF02GJZ8J.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnn

SEQ ID NO: 264202 - DNA, 283 bp, Homo sapiens
  misc_feature: GYAE6OF02JDHP6.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnnn

SEQ ID NO: 264203 - DNA, 427 bp, Homo sapiens
  misc_feature: GYAE6OF02HM693.24.53.E09.1.454.CMB.1.raw
  modified_base (422)..(427): a, c, t, g, unknown or other
  misc_feature (422)..(427): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgcccctggtcactctgttcccgccctcctcacatagtagtctgagcgggctggcaaggcgcatagnnnnnn

SEQ ID NO: 264204 - DNA, 279 bp, Homo sapiens; identical to SEQ ID NO: 263520
  misc_feature: GYAE6OF02FV3HM.24.53.E09.1.454.CMB.1.raw
  modified_base (278)..(279): a, c, t, g, unknown or other
  misc_feature (278)..(279): n is a, c, g, or t

SEQ ID NO: 264205 - DNA, 280 bp, Homo sapiens; identical to SEQ ID NO: 263488
  misc_feature: GYAE6OF02HWO3X.24.53.E09.1.454.CMB.1.raw
  modified_base (280)..(280): a, c, t, g, unknown or other
  misc_feature (280)..(280): n is a, c, g, or t

SEQ ID NO: 264206 - DNA, 280 bp, Homo sapiens; identical to SEQ ID NO: 263488
  misc_feature: GYAE6OF02IBODN.24.53.E09.1.454.CMB.1.raw
  modified_base (280)..(280): a, c, t, g, unknown or other
  misc_feature (280)..(280): n is a, c, g, or t

SEQ ID NO: 264207 - DNA, 318 bp, Homo sapiens
  misc_feature: GYAE6OF02G28M5.24.53.E09.1.454.CMB.1.raw
  modified_base (283)..(285): a, c, t, g, unknown or other
  misc_feature (283)..(285): n is a, c, g, or t
  modified_base (287)..(289): a, c, t, g, unknown or other
  misc_feature (287)..(289): n is a, c, g, or t
  modified_base (291)..(318): a, c, t, g, unknown or other
  misc_feature (291)..(318): n is a, c, g, or t
tcagactactatgtcacgaccggtgctcgatttagagagagtgtgttgggtttgggggtgtggtggtctccactcccgccttgacggggctgctatctgcctcgctggccatcacgtgggctccaggctgagggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgtcatagnnnannncnnnnnnnnnnnnnnnnnnnnnnnnnnnn

SEQ ID NO: 264208 - DNA, 432 bp, Homo sapiens
  misc_feature: GYAE6OF02JITD3.24.53.E09.1.454.CMB.1.raw
  modified_base (395)..(395): a, c, t, g, unknown or other
  misc_feature (395)..(395): n is a, c, g, or t
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtcctaggtcagcccaaggctgccccctggtcactctgttccccgccctcctcacntagtagtctgagcgggctggcaaggcgcatgnnnnnn

SEQ ID NO: 264209 - DNA, 281 bp, Homo sapiens; identical to SEQ ID NO: 263575
  misc_feature: GYAE6OF02IYFY7.24.53.E09.1.454.CMB.1.raw
  modified_base (280)..(281): a, c, t, g, unknown or other
  misc_feature (280)..(281): n is a, c, g, or t

SEQ ID NO: 264210 - DNA, 429 bp, Homo sapiens
  misc_feature: GYAE6OF02HNFNX.24.53.E09.1.454.CMB.1.raw
  modified_base (422)..(422): a, c, t, g, unknown or other
  misc_feature (422)..(422): n is a, c, g, or t
  modified_base (427)..(429): a, c, t, g, unknown or other
  misc_feature (427)..(429): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaacgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaagggcnatagnnn

SEQ ID NO: 264211 - DNA, 280 bp, Homo sapiens; identical to SEQ ID NO: 263479
  misc_feature: GYAE6OF02G08JB.24.53.E09.1.454.CMB.1.raw
  modified_base (279)..(280): a, c, t, g, unknown or other
  misc_feature (279)..(280): n is a, c, g, or t

SEQ ID NO: 264212 - DNA, 295 bp, Homo sapiens
  misc_feature: GYAE6OF02JAGD7.24.53.E09.1.454.CMB.1.raw
  modified_base (282)..(295): a, c, t, g, unknown or other
  misc_feature (282)..(295): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaaagatgttcggcggagggactaagctgaccgtcctaggtcagcccaaggctgccccctcggtcactctgttccccaccctcctcacatagtagtctgagcgggctggcaaggcgcatagnnnnnnnnnnnnnn

SEQ ID NO: 264213 - DNA, 281 bp, Homo sapiens; identical to SEQ ID NO: 263474
  misc_feature: GYAE6OF02IU2NJ.24.53.E09.1.454.CMB.1.raw
  modified_base (280)..(281): a, c, t, g, unknown or other
  misc_feature (280)..(281): n is a, c, g, or t

SEQ ID NO: 264214 - DNA, 430 bp, Homo sapiens
  misc_feature: GYAE6OF02IXP7W.24.53.E09.1.454.CMB.1.raw
  modified_base (426)..(430): a, c, t, g, unknown or other
  misc_feature (426)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctgttccccacctcctcacatagtagtctgagcgggctggcaaggcgcatagnnnnn

SEQ ID NO: 264215 - DNA, 428 bp, Homo sapiens
  misc_feature: GYAE6OF02H0NOC.24.53.E09.1.454.CMB.1.raw
  modified_base (425)..(428): a, c, t, g, unknown or other
  misc_feature (425)..(428): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtcctaggtcagcccaaggctgcccctggtcactctgttcccgccctctcacatagtagtctgagcgggctggcaggcgcatagnnnn

SEQ ID NO: 264216 - DNA, 289 bp, Homo sapiens
  misc_feature: GYAE6OF02FORPY.24.53.E09.1.454.CMB.1.raw
  modified_base (278)..(289): a, c, t, g, unknown or other
  misc_feature (278)..(289): n is a, c, g, or t
tcagactactatgtcacgaccggtgctcgatttagagagagtgtgttgggtttgggggtgtggtggtctccactcccgccttgacgggctgctatctgcctcgctggccatcactggcgtccaggctgaggatgagggtgattactactgccagtcgtcgaagatgttcggcggagggactaagctgaccgtcctaggtcagcccaaggctgcccctcggtcactctgttcccgccctcctcacatagtagtctgagcgggctggcaaggcgcatagnnnnnnnnnnnn

SEQ ID NO: 264217 - DNA, 277 bp, Homo sapiens
  misc_feature: GYAE6OF02GZ3IC.24.53.E09.1.454.CMB.1.raw
  modified_base (275)..(277): a, c, t, g, unknown or other
  misc_feature (275)..(277): n is a, c, g, or t
tcagactactatgtcacgaccggtgctcgatttagagagagtgtgttgggtttggggtgtggtggtctccactccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctctcacatagtagtctgagcgggctggcaaggcgcatagnnn

SEQ ID NO: 264218 - DNA, 314 bp, Homo sapiens
  misc_feature: GYAE6OF02H19QV.24.53.E09.1.454.CMB.1.raw
  modified_base (287)..(314): a, c, t, g, unknown or other
  misc_feature (287)..(314): n is a, c, g, or t
tcagactactatgtcacgaccggtgctcgatttagagagagtgtggttggggtttgggggtgtggtggtctaccactcccgccttgacggggctgctatctgcctcgctggccatcacgttgggctccaggctgaggatgaggtgagttactaactgccagtcgtcgaagatgttcggcggagggactaagctgaccgtcctaggtcagcccaaggctgccccctcggtcacgtctgttcccgccctcctcacatagtagtctgagcgggctggcaaggcgcatagnnnnnnnnnnnnnnnnnnnnnnnnnnnn

SEQ ID NO: 264219 - DNA, 425 bp, Homo sapiens
  misc_feature: GYAE6OF02FW0QP.24.53.E09.1.454.CMB.1.raw
  modified_base (417)..(417): a, c, t, g, unknown or other
  misc_feature (417)..(417): n is a, c, g, or t
  modified_base (423)..(425): a, c, t, g, unknown or other
  misc_feature (423)..(425): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaacagcccccaaactcctcatttatcgtaacaacaatcggccctctgggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctgttcccaccctcctcacatagtagtctgagcgggctggcaaggccncatagnnn

SEQ ID NO: 264220 - DNA, 279 bp, Homo sapiens; identical to SEQ ID NO: 263451
  misc_feature: GYAE6OF02HJHN6.24.53.E09.1.454.CMB.1.raw
  modified_base (278)..(279): a, c, t, g, unknown or other
  misc_feature (278)..(279): n is a, c, g, or t

SEQ ID NO: 264221 - DNA, 428 bp, Homo sapiens
  misc_feature: GYAE6OF02I3L1Q.24.53.E09.1.454.CMB.1.raw
  modified_base (424)..(428): a, c, t, g, unknown or other
  misc_feature (424)..(428): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctgttcccaccctcctcacatagtagtctgagcgggctggcaaggcgcatagnnnnn

SEQ ID NO: 264222 - DNA, 277 bp, Homo sapiens
  misc_feature: GYAE6OF02FRQO3.24.53.E09.1.454.CMB.1.raw
  modified_base (277)..(277): a, c, t, g, unknown or other
  misc_feature (277)..(277): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttcccaccctcctcacatagtagtctgagcgggctggcaaggcgcatagn

SEQ ID NO: 264223 - DNA, 279 bp, Homo sapiens
  misc_feature: GYAE6OF02F9HP4.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatag

SEQ ID NO: 264224 - DNA, 427 bp, Homo sapiens
  misc_feature: GYAE6OF02IG72C.24.53.E09.1.454.CMB.1.raw
  modified_base (424)..(427): a, c, t, g, unknown or other
  misc_feature (424)..(427): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcattttatcgtaacaacaatcggcctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctgttcccaccctcctcacatagtagtctgagcgggctggcaggcgcatagnnnn

SEQ ID NO: 264225 - DNA, 433 bp, Homo sapiens
  misc_feature: GYAE6OF02H45VC.24.53.E09.1.454.CMB.1.raw
  modified_base (411)..(411): a, c, t, g, unknown or other
  misc_feature (411)..(411): n is a, c, g, or t
  modified_base (427)..(433): a, c, t, g, unknown or other
  misc_feature (427)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctcgttcccaccctcctcatatagtagtctgagcgggntggcaaggcgcatagnnnnnnn

SEQ ID NO: 264226 - DNA, 283 bp, Homo sapiens
  misc_feature: GYAE6OF02GEDAK.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnn

SEQ ID NO: 264227 - DNA, 428 bp, Homo sapiens
  misc_feature: GYAE6OF02G3S31.24.53.E09.1.454.CMB.1.raw
  modified_base (424)..(428): a, c, t, g, unknown or other
  misc_feature (424)..(428): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctgttcccgccctcctcacatagtagtctgagcgggctggcaaggcgcatagnnnnn

SEQ ID NO: 264228 - DNA, 525 bp, Homo sapiens
  misc_feature: GYAE6OF02HWW9P.24.53.E09.1.454.CMB.1.raw
tcagactactatgtcacgaccggtgctcgatttagagagagtgtgttgggtttgggaggcttggtccagcctgggggtccctgagactctcctgtgcagcctctggattcccctttagtgacttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggccagggcaccctggtcaccgtctcctcagcctccaccaagggcccatccggtcttcccctggccgccctcgctccaggacgccacctccgagacgcaccgagccggcccgtgggcctggccctggtccaaggacctacttccacatacgtagtctacgg

SEQ ID NO: 264229 - DNA, 282 bp, Homo sapiens; identical to SEQ ID NO: 263482
  misc_feature: GYAE6OF02HQR8C.24.53.E09.1.454.CMB.1.raw
  modified_base (280)..(282): a, c, t, g, unknown or other
  misc_feature (280)..(282): n is a, c, g, or t

SEQ ID NO: 264230 - DNA, 282 bp, Homo sapiens
  misc_feature: GYAE6OF02GOU43.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttggggttgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnnn

SEQ ID NO: 264231 - DNA, 434 bp, Homo sapiens
  misc_feature: GYAE6OF02HAV02.24.53.E09.1.454.CMB.1.raw
  modified_base (426)..(434): a, c, t, g, unknown or other
  misc_feature (426)..(434): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtcctaggtcagcccaaggctgccccctggtcactctgttcccaccctcctcacatagtagtctgagcgggctggcaaggcgcatagnnnnnnnnn

SEQ ID NO: 264232 - DNA, 283 bp, Homo sapiens; identical to SEQ ID NO: 263736
  misc_feature: GYAE6OF02FNF07.24.53.E09.1.454.CMB.1.raw
  modified_base (281)..(283): a, c, t, g, unknown or other
  misc_feature (281)..(283): n is a, c, g, or t

SEQ ID NO: 264233 - DNA, 434 bp, Homo sapiens
  misc_feature: GYAE6OF02ISANI.24.53.E09.1.454.CMB.1.raw
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctgtcccgccctcctcacatagtacgtctgagcgggctggcaaggcgcatagnnnnnnnnn

SEQ ID NO: 264234 - DNA, 440 bp, Homo sapiens
  misc_feature: GYAE6OF02JHHTS.24.53.E09.1.454.CMB.1.raw
  modified_base (433)..(440): a, c, t, g, unknown or other
  misc_feature (433)..(440): n is a, c, g, or t
tcagactactatgtcacgaccggtgctcgatttagagagagtgtgttgggtttggggctggttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattcctccgcctccaagtctggcacctcagcctcgctggccatcactggctccaggctgaggatgagggtgattactactgcccagtcgtcgaagatgttcggcggagggactaagctgaccgtcctaggtcagcccaaggcctgcccctggtcactctcgttccccgccctcctcacatagtacgtctgacgcgggctggcaagggcgcatagnnnnnnnn

SEQ ID NO: 264235 - DNA, 281 bp, Homo sapiens
  misc_feature: GYAE6OF02HJBX1.24.53.E09.1.454.CMB.1.raw
  modified_base (281)..(281): a, c, t, g, unknown or other
  misc_feature (281)..(281): n is a, c, g, or t
tcagactactatgtcacgaccggtgctcgatttagagagagtgtgttgggtttgggggtgtggtggtctccactcccgccttgacgggcgtgctatctgcctcgctggccatcactgggcgtccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagn

SEQ ID NO: 264236 - DNA, 281 bp, Homo sapiens; identical to SEQ ID NO: 263485
  misc_feature: GYAE6OF02HUG8A.24.53.E09.1.454.CMB.1.raw
  modified_base (280)..(281): a, c, t, g, unknown or other
  misc_feature (280)..(281): n is a, c, g, or t

SEQ ID NO: 264237 - DNA, 282 bp, Homo sapiens
  misc_feature: GYAE6OF02J15VH.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnnn

SEQ ID NO: 264238 - DNA, 155 bp, Homo sapiens
  misc_feature: GYAE6OF02GVGWJ.24.53.E09.1.454.CMB.1.raw
  modified_base (155)..(155): a, c, t, g, unknown or other
  misc_feature (155)..(155): n is a, c, g, or t
tcagactactatgtcacgaccggtgctcgatttagagagagtgtgttgggtttgggggaagaggaagactgacggtcctgccacagcggccctgggctgcctggtcaaggactacttccacatagtagtctgagcgggctggcaaggcgcatagn

SEQ ID NO: 264239 - DNA, 431 bp, Homo sapiens
  misc_feature: GYAE6OF02H93ZD.24.53.E09.1.454.CMB.1.raw
  modified_base (427)..(431): a, c, t, g, unknown or other
  misc_feature (427)..(431): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtctaggtcagcccaaggctgccccctggtcactctgttcccaccctcctcacatagtagtctgagcgggctggcaaggcgcatagnnnnn

SEQ ID NO: 264240 - DNA, 281 bp, Homo sapiens; identical to SEQ ID NO: 263485
  misc_feature: GYAE6OF02F4VGG.24.53.E09.1.454.CMB.1.raw
  modified_base (280)..(281): a, c, t, g, unknown or other
  misc_feature (280)..(281): n is a, c, g, or t

SEQ ID NO: 264241 - DNA, 433 bp, Homo sapiens
  misc_feature: GYAE6OF02GNI26.24.53.E09.1.454.CMB.1.raw
  modified_base (422)..(422): a, c, t, g, unknown or other
  misc_feature (422)..(422): n is a, c, g, or t
  modified_base (428)..(433): a, c, t, g, unknown or other
  misc_feature (428)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggactccaggctgaggatgagggtgattactactgccagtcgtcgaagatgttcggcggagggactaagctgaccgtcctaggtcagcccaaggctgcccctcggtcactctgttccccaccctcctcacatagtagtctgagcgggctggcaaggcncatagnnnnnn

SEQ ID NO: 264242 - DNA, 281 bp, Homo sapiens; identical to SEQ ID NO: 263474
  misc_feature: GYAE6OF02I79FZ.24.53.E09.1.454.CMB.1.raw
  modified_base (280)..(281): a, c, t, g, unknown or other
  misc_feature (280)..(281): n is a, c, g, or t

SEQ ID NO: 264243 - DNA, 433 bp, Homo sapiens
  misc_feature: GYAE6OF02G1G9P.24.53.E09.1.454.CMB.1.raw
  modified_base (426)..(433): a, c, t, g, unknown or other
  misc_feature (426)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctcgttcccaccctcctcacatagtagtctgagcgggctggcaaggcgcatagnnnnnnnn

SEQ ID NO: 264244 - DNA, 280 bp, Homo sapiens; identical to SEQ ID NO: 263533
  misc_feature: GYAE6OF02H64RK.24.53.E09.1.454.CMB.1.raw
  modified_base (280)..(280): a, c, t, g, unknown or other
  misc_feature (280)..(280): n is a, c, g, or t

SEQ ID NO: 264245 - DNA, 441 bp, Homo sapiens
  misc_feature: GYAE6OF02J2IJ3.24.53.E09.1.454.CMB.1.raw
  modified_base (161)..(161): a, c, t, g, unknown or other
  misc_feature (161)..(161): n is a, c, g, or t
  modified_base (429)..(441): a, c, t, g, unknown or other
  misc_feature (429)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtctaggtcagcccaaggctgccccctggtcactctcgttccccaccctcctcacatagtagtctgacgcgggctggcaaggcgcatagnnnnnnnnnnnnn

SEQ ID NO: 264246 - DNA, 281 bp, Homo sapiens; identical to SEQ ID NO: 263461
  misc_feature: GYAE6OF02HJPMB.24.53.E09.1.454.CMB.1.raw
  modified_base (280)..(281): a, c, t, g, unknown or other
  misc_feature (280)..(281): n is a, c, g, or t

SEQ ID NO: 264247 - DNA, 460 bp, Homo sapiens
  misc_feature: GYAE6OF02IZH04.24.53.E09.1.454.CMB.1.raw
  modified_base (435)..(460): a, c, t, g, unknown or other
  misc_feature (435)..(460): n is a, c, g, or t
tcagactactatgtcacgaccggtgctcgatttagagagagtgtgttgggtttgggggctgttttggaagctgcttgtaccagagggtcaccattctcctgcactgggagcaacatcggcgcaggttttgatgtccactggtacaagcagcttcctaaaaacagcccccaaactcctacatttatcgtaacaacaatcggccctctggggtccctgaccgagttctccgcctccaagtcctgggcacctcagcctcgctggccatcactgggctccaggctgaggatgagggtgattactactgcccagtcgtcgaagagtgttcggcggagggactaagctgaccgtcctaggtcagcccaaggctgcccctggtcactctgtcccgccctcctccacatacgtagtctgagcgggctggcaaggccgcatagnnnnnnnnnnnnnnnnnnnnnnnnnn

SEQ ID NO: 264248 - DNA, 429 bp, Homo sapiens
  misc_feature: GYAE6OF02G1L9H.24.53.E09.1.454.CMB.1.raw
  modified_base (424)..(429): a, c, t, g, unknown or other
  misc_feature (424)..(429): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggccatcactggctccaggctgagatgagggtgattactactgcccagtcgtcgaagatgttcggcggagggactaagctgaccgtcctaggtcagcccaaggctgccccctggtcactctgttcccgccctcctcacatagtagtctgagcgggctggcaaggcgcatagnnnnnn

SEQ ID NO: 264249 - DNA, 276 bp, Homo sapiens
  misc_feature: GYAE6OF02GIFPY.24.53.E09.1.454.CMB.1.raw
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatag

SEQ ID NO: 264250 - DNA, 358 bp, Homo sapiens
  misc_feature: GYAE6OF02GZ2LP.24.53.E09.1.454.CMB.1.raw
  modified_base (143)..(143): a, c, t, g, unknown or other
  misc_feature (143)..(143): n is a, c, g, or t
  modified_base (304)..(304): a, c, t, g, unknown or other
  misc_feature (304)..(304): n is a, c, g, or t
  modified_base (306)..(307): a, c, t, g, unknown or other
  misc_feature (306)..(307): n is a, c, g, or t
  modified_base (311)..(313): a, c, t, g, unknown or other
  misc_feature (311)..(313): n is a, c, g, or t
  modified_base (315)..(322): a, c, t, g, unknown or other
  misc_feature (315)..(322): n is a, c, g, or t
  modified_base (324)..(358): a, c, t, g, unknown or other
  misc_feature (324)..(358): n is a, c, g, or t
tcagactactatgtcacgaccggtgctcgatttagagagagtgtggttaggggttgggggtgtggtggtctccactcccgcttgaacgggctgctatctgcctcgctggccatcactagggctccaggctgaggatgagggtnattactactagccagtcgtcgaagatgttacggcggagggactaagcctggaaccgtcgtaggtcacggcccaaggctggccccctggtcactctgttccccacctcctcacgatagttagcctgggacgccgggctggccaaaggccgcaatacgcagcntnntccnnncnnnnnnnncnnnnnnnnnnnnnnnnnnnnnnnnnnnnnnnnnnn

SEQ ID NO: 264251 - DNA, 281 bp, Homo sapiens; identical to SEQ ID NO: 263523
  misc_feature: GYAE6OF02IZEK8.24.53.E09.1.454.CMB.1.raw
  modified_base (281)..(281): a, c, t, g, unknown or other
  misc_feature (281)..(281): n is a, c, g, or t

SEQ ID NO: 264252 - DNA, 438 bp, Homo sapiens
  misc_feature: GYAE6OF02G224N.24.53.E09.1.454.CMB.1.raw
  modified_base (161)..(161): a, c, t, g, unknown or other
  misc_feature (161)..(161): n is a, c, g, or t
  modified_base (288)..(288): a, c, t, g, unknown or other
  misc_feature (288)..(288): n is a, c, g, or t
  modified_base (422)..(422): a, c, t, g, unknown or other
  misc_feature (422)..(422): n is a, c, g, or t
  modified_base (428)..(438): a, c, t, g, unknown or other
  misc_feature (428)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatggttcggcggagggactaagctgaccgtcctaggcagcccaaggctcgcccctggtcactctcgttccccgccctcctcacatacgtatctgagcgggctggcaaggcncatagnnnnnnnnnnn

SEQ ID NO: 264253 - DNA, 541 bp, Homo sapiens
  misc_feature: GYAE6OF02HBRFB.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttcagcattggggccagggcacccgtggtccaccgtctcctcacgcctccaccaacgggcccacgtccggtccttcccccgtggcccgccctcgcctcccacggacgccaccctccgagacgcacgacgcggccctgggccgtgcccgtggtaccaaggacctacttcccacactagtagtctacgg

SEQ ID NO: 264254 - DNA, 279 bp, Homo sapiens; identical to SEQ ID NO: 264199
  misc_feature: GYAE6OF02HKXOO.24.53.E09.1.454.CMB.1.raw
  modified_base (279)..(279): a, c, t, g, unknown or other
  misc_feature (279)..(279): n is a, c, g, or t

SEQ ID NO: 264255 - DNA, 284 bp, Homo sapiens; identical to SEQ ID NO: 263514
  misc_feature: GYAE6OF02HDSKF.24.53.E09.1.454.CMB.1.raw
  modified_base (280)..(284): a, c, t, g, unknown or other
  misc_feature (280)..(284): n is a, c, g, or t

SEQ ID NO: 264256 - DNA, 439 bp, Homo sapiens
  misc_feature: GYAE6OF02JCESM.24.53.E09.1.454.CMB.1.raw
  modified_base (421)..(421): a, c, t, g, unknown or other
  misc_feature (421)..(421): n is a, c, g, or t
  modified_base (427)..(439): a, c, t, g, unknown or other
  misc_feature (427)..(439): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctagtcagcccaaggctgcccctggtcactctcgttccccaccctcctcacatacgtagtctgagcgggctggcaaggcncatagnnnnnnnnnnnnn

SEQ ID NO: 264257 - DNA, 433 bp, Homo sapiens
  misc_feature: GYAE6OF02I3VXZ.24.53.E09.1.454.CMB.1.raw
  modified_base (425)..(433): a, c, t, g, unknown or other
  misc_feature (425)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctgttcccgccctcctcacatagtagtctgagcgggctggcaaggcgcatagnnnnnnnnn

SEQ ID NO: 264258 - DNA, 433 bp, Homo sapiens
  misc_feature: GYAE6OF02IS86V.24.53.E09.1.454.CMB.1.raw
  modified_base (427)..(433): a, c, t, g, unknown or other
  misc_feature (427)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctcggtcactctgttccccaccctcctcacatagtagtctgagcgggctggcaaggcgcatagnnnnnnn

SEQ ID NO: 264259 - DNA, 533 bp, Homo sapiens
  misc_feature: GYAE6OF02I7QUJ.24.53.E09.1.454.CMB.1.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (513)..(533): a, c, t, g, unknown or other
  misc_feature (513)..(533): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctggagntggnggtntatactactcgactagtcgtacgaagtagttcggtcgggacgggagggtaactaacgcgtacggtacccgttcgtacggtccgaccgacccgaaggtccgtcccgtcccccgttcggtacctaccttccgttcccgttaccccctaccccttcctaccaactaacgttaacgttacgttcgtaggacgggccgggtcgtcggaacggaacggccgactagtagcnnnnnnnnnnnnnnnnnnnnn

SEQ ID NO: 264260 - DNA, 284 bp, Homo sapiens
  misc_feature: GYAE6OF02GD2W3.24.53.E09.1.454.CMB.1.raw
  modified_base (280)..(284): a, c, t, g, unknown or other
  misc_feature (280)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnnnnn

SEQ ID NO: 264261 - DNA, 288 bp, Homo sapiens
  misc_feature: GYAE6OF02G1FA8.24.53.E09.1.454.CMB.1.raw
  modified_base (279)..(279): a, c, t, g, unknown or other
  misc_feature (279)..(279): n is a, c, g, or t
  modified_base (282)..(288): a, c, t, g, unknown or other
  misc_feature (282)..(288): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnaannnnnnn

SEQ ID NO: 264262 - DNA, 441 bp, Homo sapiens
  misc_feature: GYAE6OF02IIO9K.24.53.E09.1.454.CMB.1.raw
  modified_base (317)..(317): a, c, t, g, unknown or other
  misc_feature (317)..(317): n is a, c, g, or t
  modified_base (385)..(385): a, c, t, g, unknown or other
  misc_feature (385)..(385): n is a, c, g, or t
  modified_base (430)..(441): a, c, t, g, unknown or other
  misc_feature (430)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggccacctcagccctcgctggccatcactgggctccaggctggaggatggagggtgattactactgccagtcgtcgaagntggtcggcggaggactaagctgaccgtctaggtcagcccaaggctcgcccctggtcactctcgtcccnccctctcacatagtagtctgaggcgggctggcaaggcgacatagnnnnnnnnnnnn

SEQ ID NO: 264263 - DNA, 292 bp, Homo sapiens
  misc_feature: GYAE6OF02GQAZV.24.53.E09.1.454.CMB.1.raw
  modified_base (280)..(292): a, c, t, g, unknown or other
  misc_feature (280)..(292): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnnnnnnnnnn

SEQ ID NO: 264264 - DNA, 453 bp, Homo sapiens
  misc_feature: GYAE6OF02J3A7T.24.53.E09.1.454.CMB.1.raw
  modified_base (439)..(453): a, c, t, g, unknown or other
  misc_feature (439)..(453): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctcaggctgaggatgagggtgattactactgcccagtcgtcgaagatgttcggcggagggactaagctgaccgtctaggtcagcccaaggctgcccctggtcactctcgttccccgccctctcactatacgttagctggaggccggggtctgggccaaagggccacgtatagcnnnnnnnnnnnnnnn

SEQ ID NO: 264265 - DNA, 438 bp, Homo sapiens
  misc_feature: GYAE6OF02H2GCZ.24.53.E09.1.454.CMB.1.raw
  modified_base (433)..(438): a, c, t, g, unknown or other
  misc_feature (433)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtcctaggtcagcccaaggctgccccctggtcactctgttccccaccctcctcaccatagtagtcctgagcgggctgggcaagggcgcatagnnnnnn

SEQ ID NO: 264266 - DNA, 156 bp, Homo sapiens; identical to SEQ ID NO: 263466
  misc_feature: GYAE6OF02IACP9.24.53.E09.1.454.CMB.1.raw
  modified_base (155)..(156): a, c, t, g, unknown or other
  misc_feature (155)..(156): n is a, c, g, or t

SEQ ID NO: 264267 - DNA, 434 bp, Homo sapiens
  misc_feature: GYAE6OF02GAZ6U.24.53.E09.1.454.CMB.1.raw
  modified_base (427)..(434): a, c, t, g, unknown or other
  misc_feature (427)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctcggtcactctcgttcccaccctcctcacatagtagtctgagcgggctggcaaggcgcatagnnnnnnnn

SEQ ID NO: 264268 - DNA, 282 bp, Homo sapiens; identical to SEQ ID NO: 263509
  misc_feature: GYAE6OF02IV4U1.24.53.E09.1.454.CMB.1.raw
  modified_base (280)..(282): a, c, t, g, unknown or other
  misc_feature (280)..(282): n is a, c, g, or t

SEQ ID NO: 264269 - DNA, 435 bp, Homo sapiens
  misc_feature: GYAE6OF02I12MX.24.53.E09.1.454.CMB.1.raw
  modified_base (419)..(419): a, c, t, g, unknown or other
  misc_feature (419)..(419): n is a, c, g, or t
  modified_base (425)..(435): a, c, t, g, unknown or other
  misc_feature (425)..(435): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtctaggtcagcccaaggctgccccctggtcactctgttccccgccctcctcacatagtagtctgagcgggctggcaaggcncatagnnnnnnnnnnn

SEQ ID NO: 264270 - DNA, 281 bp, Homo sapiens; identical to SEQ ID NO: 263461
  misc_feature: GYAE6OF02IZM2S.24.53.E09.1.454.CMB.1.raw
  modified_base (280)..(281): a, c, t, g, unknown or other
  misc_feature (280)..(281): n is a, c, g, or t

SEQ ID NO: 264271 - DNA, 281 bp, Homo sapiens; identical to SEQ ID NO: 263535
  misc_feature: GYAE6OF02IEIP1.24.53.E09.1.454.CMB.1.raw
  modified_base (279)..(281): a, c, t, g, unknown or other
  misc_feature (279)..(281): n is a, c, g, or t

SEQ ID NO: 264272 - DNA, 282 bp, Homo sapiens
  misc_feature: GYAE6OF02JA2XL.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgagtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnn

SEQ ID NO: 264273 - DNA, 284 bp, Homo sapiens
  misc_feature: GYAE6OF02H74K6.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagnnnn

SEQ ID NO: 264274 - DNA, 280 bp, Homo sapiens
  misc_feature: GYAE6OF02F9Z2J.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnn

SEQ ID NO: 264275 - DNA, 381 bp, Homo sapiens
  misc_feature: GYAE6OF02F7LF8.24.53.E09.1.454.CMB.1.raw
  modified_base (376)..(381): a, c, t, g, unknown or other
  misc_feature (376)..(381): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacgacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnnn

SEQ ID NO: 264276 - DNA, 281 bp, Homo sapiens; identical to SEQ ID NO: 263461
  misc_feature: GYAE6OF02IEZ6U.24.53.E09.1.454.CMB.1.raw
  modified_base (280)..(281): a, c, t, g, unknown or other
  misc_feature (280)..(281): n is a, c, g, or t

SEQ ID NO: 264277 - DNA, 279 bp, Homo sapiens
  misc_feature: GYAE6OF02IB4DJ.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgagtatgagggtgattactactgccagtcgtcgaagatgttcggcggagggactaagctgaccgtcctaggtcagcccaaggctgccccctcggtcactctgttcccgcctcctcacatagtagtctgagcgggctggcaaggcgcatagn

SEQ ID NO: 264278 - DNA, 282 bp, Homo sapiens; identical to SEQ ID NO: 263490
  misc_feature: GYAE6OF02I9DMK.24.53.E09.1.454.CMB.1.raw
  modified_base (280)..(282): a, c, t, g, unknown or other
  misc_feature (280)..(282): n is a, c, g, or t

SEQ ID NO: 264279 - DNA, 282 bp, Homo sapiens
  misc_feature: GYAE6OF02IKTD4.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctgggcaaggcgcatagnn

SEQ ID NO: 264280 - DNA, 436 bp, Homo sapiens
  misc_feature: GYAE6OF02HVA4I.24.53.E09.1.454.CMB.1.raw
  modified_base (426)..(436): a, c, t, g, unknown or other
  misc_feature (426)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgcccctggtcactctgttcccaccctcctccatacgtagtctgagcgggctggcaaggcgcatagnnnnnnnnnnn

SEQ ID NO: 264281 - DNA, 282 bp, Homo sapiens
  misc_feature: GYAE6OF02G0BCL.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggcgtggcaaggcgcatagnn

SEQ ID NO: 264282 - DNA, 447 bp, Homo sapiens
  misc_feature: GYAE6OF02HDOSF.24.53.E09.1.454.CMB.1.raw
  modified_base (429)..(429): a, c, t, g, unknown or other
  misc_feature (429)..(429): n is a, c, g, or t
  modified_base (433)..(447): a, c, t, g, unknown or other
  misc_feature (433)..(447): n is a, c, g, or t
tcagactactatgtcacgaccggtgctcgatttagagagagtgtgttggggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaaggctgaccgtctaggtcagcccaaggctgcccctggtccactctcgttccccaccctcctcactatacgtagtctgacggcgggctggcaaggcgnatgnnnnnnnnnnnnnnn

SEQ ID NO: 264283 - DNA, 282 bp, Homo sapiens
  misc_feature: GYAE6OF02HV1EH.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnn

SEQ ID NO: 264284 - DNA, 286 bp, Homo sapiens
  misc_feature: GYAE6OF02H0QZE.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagngggggg

SEQ ID NO: 264285 - DNA, 432 bp, Homo sapiens
  misc_feature: GYAE6OF02HYY0S.24.53.E09.1.454.CMB.1.raw
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnnn

SEQ ID NO: 264286 - DNA, 280 bp, Homo sapiens; identical to SEQ ID NO: 263488
  misc_feature: GYAE6OF02GJYU8.24.53.E09.1.454.CMB.1.raw
  modified_base (280)..(280): a, c, t, g, unknown or other
  misc_feature (280)..(280): n is a, c, g, or t

SEQ ID NO: 264287 - DNA, 282 bp, Homo sapiens; identical to SEQ ID NO: 263490
  misc_feature: GYAE6OF02IV1N0.24.53.E09.1.454.CMB.1.raw
  modified_base (280)..(282): a, c, t, g, unknown or other
  misc_feature (280)..(282): n is a, c, g, or t

SEQ ID NO: 264288 - DNA, 317 bp, Homo sapiens
  misc_feature: GYAE6OF02FTIVZ.24.53.E09.1.454.CMB.1.raw
  modified_base (286)..(317): a, c, t, g, unknown or other
  misc_feature (286)..(317): n is a, c, g, or t
tcagactactatgtcacgaccggtgctcgatttagagagagtgtgttgggtttggggggtggtggtggtctccactcccgccttgacggggctgctatctgcctcgctggccatcactgggctccaggctgaggatgagggtgattactactgccagtcgtcgaagatgttcggcggagggactaagctgaccgttcctaggtcagcccaaggcctgccccctggtcactctgttccccaccctcctcacatagtagtcctggagcgggctggcaaggcgcatagnnnnnnnnnnnnnnnnnnnnnnnnnnnnnnnn

SEQ ID NO: 264289 - DNA, 281 bp, Homo sapiens
  misc_feature: GYAE6OF02IYTFV.24.53.E09.1.454.CMB.1.raw
  modified_base (273)..(273): a, c, t, g, unknown or other
  misc_feature (273)..(273): n is a, c, g, or t
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctcactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcncatagnnn

SEQ ID NO: 264290 - DNA, 280 bp, Homo sapiens; identical to SEQ ID NO: 263488
  misc_feature: GYAE6OF02JI5AK.24.53.E09.1.454.CMB.1.raw
  modified_base (280)..(280): a, c, t, g, unknown or other
  misc_feature (280)..(280): n is a, c, g, or t

SEQ ID NO: 264291 - DNA, 281 bp, Homo sapiens; identical to SEQ ID NO: 263535
  misc_feature: GYAE6OF02HI49A.24.53.E09.1.454.CMB.1.raw
  modified_base (279)..(281): a, c, t, g, unknown or other
  misc_feature (279)..(281): n is a, c, g, or t

SEQ ID NO: 264292 - DNA, 559 bp, Homo sapiens
  misc_feature: GYAE6OF02JARHR.24.53.E09.1.454.CMB.1.raw
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (536)..(536): a, c, t, g, unknown or other
  misc_feature (536)..(536): n is a, c, g, or t
  modified_base (540)..(559): a, c, t, g, unknown or other
  misc_feature (540)..(559): n is a, c, g, or t
tcagactactatgtcacgaccggtgctcgatttagagagagtgtgttgggtttgggggctgtttttggaagctgcttgtaccagagggtcgaccactctcctcgcactggaggcaacatcggcgcgaggttttgtatgtccactaggtacgaagacagcttaccaaaacaacgaccccaaacctacctctattattacgtaacaaacaactacggtcccgtccgtcgtcgggtcccgtacgtaccgtacttcctccncncgctcaagtcctcgcacctccacgcctcgctgccagtcgactcggcgtccgaggcgtgaggagtgtaggtagtacttactacgtgtccgtaggtacgtacgtaggtacggtggtacggacggaggacgtaacgacgtacgtaccgtaccgtacggtacgacgccgacggccgtcgccccgtaccggtcctaccgtccctaccgttccctaccctacctactacgtacgttacgtacgtacgtcggacggtacgggacgtacggacgacgacgacganagcnnnnnnnnnnnnnnnnnnnn

SEQ ID NO: 264293 - DNA, 279 bp, Homo sapiens
  misc_feature: GYAE6OF02JD412.24.53.E09.1.454.CMB.1.raw
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatag

SEQ ID NO: 264294 - DNA, 280 bp, Homo sapiens; identical to SEQ ID NO: 263547
  misc_feature: GYAE6OF02IJES6.24.53.E09.1.454.CMB.1.raw
  modified_base (279)..(280): a, c, t, g, unknown or other
  misc_feature (279)..(280): n is a, c, g, or t

SEQ ID NO: 264295 - DNA, 383 bp, Homo sapiens
  misc_feature: GYAE6OF02HX0PN.24.53.E09.1.454.CMB.1.raw
  modified_base (372)..(372): a, c, t, g, unknown or other
  misc_feature (372)..(372): n is a, c, g, or t
  modified_base (378)..(383): a, c, t, g, unknown or other
  misc_feature (378)..(383): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtctgagcgggctggcaaggcncatagnnnnnn

SEQ ID NO: 264296 - DNA, 281 bp, Homo sapiens; identical to SEQ ID NO: 263474
  misc_feature: GYAE6OF02FSE3E.24.53.E09.1.454.CMB.1.raw
  modified_base (280)..(281): a, c, t, g, unknown or other
  misc_feature (280)..(281): n is a, c, g, or t

SEQ ID NO: 264297 - DNA, 280 bp, Homo sapiens; identical to SEQ ID NO: 263533
  misc_feature: GYAE6OF02GG9O6.24.53.E09.1.454.CMB.1.raw
  modified_base (280)..(280): a, c, t, g, unknown or other
  misc_feature (280)..(280): n is a, c, g, or t

SEQ ID NO: 264298 - DNA, 432 bp, Homo sapiens
  misc_feature: GYAE6OF02HHGHY.24.53.E09.1.454.CMB.1.raw
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaagctgccccctggtcactctcgttcccaccctcctcactatagtagtctgagcgggctggcaaggcgcatagnnnnnn

SEQ ID NO: 264299 - DNA, 435 bp, Homo sapiens
  misc_feature: GYAE6OF02JATE4.24.53.E09.1.454.CMB.1.raw
  modified_base (424)..(424): a, c, t, g, unknown or other
  misc_feature (424)..(424): n is a, c, g, or t
  modified_base (429)..(435): a, c, t, g, unknown or other
  misc_feature (429)..(435): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagccctcgctggccatcactgggctccaggctgaggatgagggtgattactactgccagtcgtcgaagatgttcggcggagggactaagctgaccgtcctaggtcagcccaaggctcgcccctggtcactctcgttccccaccctcctcacatagtagtctgagcgggctggcaaggcgnatagnnnnnnn

SEQ ID NO: 264300 - DNA, 283 bp, Homo sapiens
  misc_feature: GYAE6OF02GR1SQ.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctagctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnn

SEQ ID NO: 264301 - DNA, 570 bp, Homo sapiens
  misc_feature: GYAE6OF02I9GG3.24.53.E09.1.454.CMB.1.raw
  modified_base (312)..(312): a, c, t, g, unknown or other
  misc_feature (312)..(312): n is a, c, g, or t
  modified_base (508)..(508): a, c, t, g, unknown or other
  misc_feature (508)..(508): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(543): a, c, t, g, unknown or other
  misc_feature (543)..(543): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
tcagactactatgtcacgaccggtgctcgatttagagagagtgtgttggggtttgggggcgtgttttgggtaagcgtgcttgtaccagagggatcaccagtcctcctgcactcgggaggcaaccatcggcgcagggtttgatggtcactggtacagcagcttccaaaaacagccccaaacctcctcactttatccgtaacaacaatcggccctcgtggggtccctgaccgattcctccgcctccaagttctcgggcaacctcgaacgcctcgctggcctaatcgactggactcagctggacggactgaggtnattactactgccagtcgacgaacgattggttccggacgggtaggggtacctaaggcgttacggtaccgtcgtagggtcagggtcccaaagggtcctcggccccctaggtctacctcttccgttcccacccgttctcactattacgtagtctggtacggcgggtcttgggcaaaggtctcgattacgcagtatcatntcgtcgacgacgacactacatacgaacngngnncncactctgtctctctctctcnctntntc

SEQ ID NO: 264302 - DNA, 430 bp, Homo sapiens
  misc_feature: GYAE6OF02GM0US.24.53.E09.1.454.CMB.1.raw
  modified_base (418)..(418): a, c, t, g, unknown or other
  misc_feature (418)..(418): n is a, c, g, or t
  modified_base (424)..(430): a, c, t, g, unknown or other
  misc_feature (424)..(430): n is a, c, g, or t
tcagactactatgtcacgaccggtgctcgatttagagagagtgtgttgagtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctgttcccaccctcctcacatagtagtctgagcgggctggcaaggcncatagnnnnnnn

SEQ ID NO: 264303 - DNA, 281 bp, Homo sapiens
  misc_feature: GYAE6OF02H86KP.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnn

SEQ ID NO: 264304 - DNA, 299 bp, Homo sapiens
  misc_feature: GYAE6OF02IZ7NP.24.53.E09.1.454.CMB.1.raw
  modified_base (280)..(299): a, c, t, g, unknown or other
  misc_feature (280)..(299): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgatttactactgccagtcgtcgaagatgttcggcggagggactaagctgaccgtctaggtcagcccaaggctgccccctggtcactctgttccccaccctcctcacatagtagtctgagcgggctggcaaggcgcatagnnnnnnnnnnnnnnnnnnnn

SEQ ID NO: 264305 - DNA, 304 bp, Homo sapiens
  misc_feature: GYAE6OF02HA9YP.24.53.E09.1.454.CMB.1.raw
  modified_base (264)..(264): a, c, t, g, unknown or other
  misc_feature (264)..(264): n is a, c, g, or t
  modified_base (285)..(304): a, c, t, g, unknown or other
  misc_feature (285)..(304): n is a, c, g, or t
tcagactactatgtcacgaccggtgctcgatttagagagagtgtgttgggtttgggggtgtggtggtctcctactcccgccttgacggggctggcgtagtctgcctcgctggccatcactgggctccaggctgaggatgagggtgacttactactgccagtcgtcgaagatgttcggcggagggactaagctgaccgtcctaggtcagcccaaggctgccccctggtcactcctgttcccgccctcctcacatagtagtctgancgggctggcaaggcgcatagnnnnnnnnnnnnnnnnnnnn

SEQ ID NO: 264306 - DNA, 350 bp, Homo sapiens
  misc_feature: GYAE6OF02JCAII.24.53.E09.1.454.CMB.1.raw
  modified_base (285)..(285): a, c, t, g, unknown or other
  misc_feature (285)..(285): n is a, c, g, or t
  modified_base (291)..(350): a, c, t, g, unknown or other
  misc_feature (291)..(350): n is a, c, g, or t
tcagactactatgtcacgaccggtgctcgatttagagagagtgtgttgggtttggggggtgtagggtgggtctccactcccgccttgacggggctgctatcctgcctcgctggcccatcactcgggctccaggctgaggatgagggtgattactactgccagtcgtcgaagatgttcggcggacgggacctaaggcttgaccgtcctaggtcagcccaaggcctgccccctcggtcactctgttcccacctcctcacatagtactctgagcgggctggcaaggcncatagnnnnnnnnnnnnnnnnnnnnnnnnnnnnnnnnnnnnnnnnnnnnnnnnnnnnnnnnnnnn

SEQ ID NO: 264307 - DNA, 557 bp, Homo sapiens
  misc_feature: GYAE6OF02HVCFG.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccattcaccatctccagagacaacgcccagaactcactgtatctggaaatgaccagcctgagagtcgaggacacggctatgtattactgtgcgaccatatcagccacctggagtcgcatctagaatacttcagctagttcggggccagggccacccgtggtccaccgtctcctcacgcctccaccgaacggcccagtccggtcccttccccgtggccgccctcgcctccgaggacgccaccgtccgagacgcacgacgccggcccgtgggcctcggccgtcggtaccgaacggtaccttaccttcccaactactacggtacgtcgtacgg

SEQ ID NO: 264308 - DNA, 279 bp, Homo sapiens
  misc_feature: GYAE6OF02G7H0D.24.53.E09.1.454.CMB.1.raw
  modified_base (279)..(279): a, c, t, g, unknown or other
  misc_feature (279)..(279): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgtttccgccctcctcacatagtagtctgagcgggctggcaaggcgcatagn

SEQ ID NO: 264309 - DNA, 281 bp, Homo sapiens; identical to SEQ ID NO: 263523
  misc_feature: GYAE6OF02G5T2X.24.53.E09.1.454.CMB.1.raw
  modified_base (281)..(281): a, c, t, g, unknown or other
  misc_feature (281)..(281): n is a, c, g, or t

SEQ ID NO: 264310 - DNA, 280 bp, Homo sapiens; identical to SEQ ID NO: 263476
  misc_feature: GYAE6OF02GY34O.24.53.E09.1.454.CMB.1.raw
  modified_base (280)..(280): a, c, t, g, unknown or other
  misc_feature (280)..(280): n is a, c, g, or t

SEQ ID NO: 264311 - DNA, 281 bp, Homo sapiens
  misc_feature: GYAE6OF02GC2TF.24.53.E09.1.454.CMB.1.raw
  modified_base (280)..(281): a, c, t, g, unknown or other
  misc_feature (280)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnn

SEQ ID NO: 264312 - DNA, 305 bp, Homo sapiens
  misc_feature: GYAE6OF02GFT48.24.53.E09.1.454.CMB.1.raw
  modified_base (279)..(305): a, c, t, g, unknown or other
  misc_feature (279)..(305): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatacgnnnnnnnnnnnnnnnnnnnnnnnnnnn

SEQ ID NO: 264313 - DNA, 329 bp, Homo sapiens
  misc_feature: GYAE6OF02JAP60.24.53.E09.1.454.CMB.1.raw
  modified_base (328)..(329): a, c, t, g, unknown or other
  misc_feature (328)..(329): n is a, c, g, or t
tcagactactatgtcacgaccggtgctcgatttagagagagtgtgttgggtttgggggtgtggtggtctccactcccgccttgacggggctgctatctgcctcgctggccatcactgggcctcgagctgaggatggagggtgtattactactcgcctagtcgtacgaagtagttggttcgggcgggagggaactaagtcgtcggtacccgttccgtaggtcaccgacccgaacggtcgtcccgcccccgtcggtccaccttcgttccgttccccacccctcctacactatagtacgtcgtgacggcggcgtggacaaggcgcagtagnn

SEQ ID NO: 264314 - DNA, 434 bp, Homo sapiens
  misc_feature: GYAE6OF02HAVFG.24.53.E09.1.454.CMB.1.raw
  modified_base (161)..(161): a, c, t, g, unknown or other
  misc_feature (161)..(161): n is a, c, g, or t
  modified_base (182)..(182): a, c, t, g, unknown or other
  misc_feature (182)..(182): n is a, c, g, or t
  modified_base (288)..(288): a, c, t, g, unknown or other
  misc_feature (288)..(288): n is a, c, g, or t
  modified_base (418)..(418): a, c, t, g, unknown or other
  misc_feature (418)..(418): n is a, c, g, or t
  modified_base (424)..(434): a, c, t, g, unknown or other
  misc_feature (424)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttancgtaacaacaatcggccctctggggtccctgaccgattctccgcctccaagtctggcacctcagcctcgctggccatcactgggctccaggctgaggatgagggtnattactactgccagtcgtcgaagatgttcggcggagggactaagctgaccgtctaggtcagcccaaggctcgcccctggtcactctgttccccacctcctcacatagtgtctgagcgggctggcaaggcncatagnnnnnnnnnnn

SEQ ID NO: 264315 - DNA, 382 bp, Homo sapiens
  misc_feature: GYAE6OF02H9OP7.24.53.E09.1.454.CMB.1.raw
  modified_base (323)..(323): a, c, t, g, unknown or other
  misc_feature (323)..(323): n is a, c, g, or t
  modified_base (376)..(382): a, c, t, g, unknown or other
  misc_feature (376)..(382): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattacactgccagtccgtcgaagatgttcggcggagggactaagctgaccgtctaggtcagcccaaggctgccccctggtcactcngttccccgccctcctcacatagtagtctgacgcgggctggcaaggcgcatagnnnnnnn

SEQ ID NO: 264316 - DNA, 503 bp, Homo sapiens
  misc_feature: GYAE6OF02GGHDW.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggccagggcaccctggtcaccgtctcctcagcctccaccaggcccatcgtcttcccctgcgccctgctccaggacgcacctccgagagcacagcgcctgggctgcctggtcaagactactccacatagtagtctgg

SEQ ID NO: 264317 - DNA, 435 bp, Homo sapiens
  misc_feature: GYAE6OF02GRK55.24.53.E09.1.454.CMB.1.raw
  modified_base (428)..(435): a, c, t, g, unknown or other
  misc_feature (428)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgcccctggtcactctcgttcccgccctcctcacatagtagtctgagcgggctggcaaggcgcatagnnnnnnnn

SEQ ID NO: 264318 - DNA, 283 bp, Homo sapiens; identical to SEQ ID NO: 263761
  misc_feature: GYAE6OF02F7BFU.24.53.E09.1.454.CMB.1.raw
  modified_base (280)..(283): a, c, t, g, unknown or other
  misc_feature (280)..(283): n is a, c, g, or t

SEQ ID NO: 264319 - DNA, 297 bp, Homo sapiens
  misc_feature: GYAE6OF02I7SAL.24.53.E09.1.454.CMB.1.raw
  modified_base (280)..(280): a, c, t, g, unknown or other
  misc_feature (280)..(280): n is a, c, g, or t
  modified_base (282)..(297): a, c, t, g, unknown or other
  misc_feature (282)..(297): n is a, c, g, or t
tcagactactatgtcacgaccggtgctcgatttagagagagtgtgttgggtttggggtgtggtggtctcactccgccttgacgggctgctatctgcctcgctggccatcactgggctccgaggctgaggatgagggtgattactactgccagtcgtcgaagatgttcggcggagggactaagctgaccgtcctaggtcagcccaaggctgccccctggtcactctgttccccacctcctcacatagtagtctgagcgggctgggaccaaggccgcatagnannnnnnnnnnnnnnnn

SEQ ID NO: 264320 - DNA, 281 bp, Homo sapiens
  misc_feature: GYAE6OF02IINXQ.24.53.E09.1.454.CMB.1.raw
  modified_base (277)..(281): a, c, t, g, unknown or other
  misc_feature (277)..(281): n is a, c, g, or t
tcagactactatgtcacgaccggtgctcgatttagagagagtgtgttgggtttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttcccgccctcctcacatagtagtctgagcgggctggcaaggcgcatagnnnnn

SEQ ID NO: 264321 - DNA, 282 bp, Homo sapiens; identical to SEQ ID NO: 263902
  misc_feature: GYAE6OF02ITA6R.24.53.E09.1.454.CMB.1.raw
  modified_base (279)..(282): a, c, t, g, unknown or other
  misc_feature (279)..(282): n is a, c, g, or t

SEQ ID NO: 264322 - DNA, 601 bp, Homo sapiens
  misc_feature: GYAE6OF02IZQOY.24.53.E09.1.454.CMB.1.raw
  modified_base (459)..(459): a, c, t, g, unknown or other
  misc_feature (459)..(459): n is a, c, g, or t
tcagactactatgtcacgaccggtgctcgatttagagagagtgtgttggggtttgggaggcttggtccagcctggggggtcccctgacgactctccctgtgtcagtcctctggattcccctttagtgacttttggatgacctgggtccgccaggctccgaggggacggggctggagttggggttggcctaattattaaggcacgatggacgtagcatgtactatggtggactctggtgaagggtccgattcaccatctccagagacaacgcccagaactcactgtatctggaaatgaccagcctgagagtcgaggacacggctatgtattactgtgcgaccatatcgagctacctggacgtcgcatctgaatacttcagcagttcgggcagggcaccgtggtcaccgtctcctcacgcctccaccgaacggcccaagttccgtccttccccgtggcccnccctgccttccgacggacgaccacccgtaccgaacgacgaccaccgacgtcccggtcccgttagggtccgtcggcccgttacgggtaaccgaacgggttccttaccgttccgtaacgtacgttacggttacgtcgtaacggg

SEQ ID NO: 264323 - DNA, 280 bp, Homo sapiens
  misc_feature: GYAE6OF02FIAWU.24.53.E09.1.454.CMB.1.raw
  modified_base (280)..(280): a, c, t, g, unknown or other
  misc_feature (280)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagn

SEQ ID NO: 264324 - DNA, 283 bp, Homo sapiens; identical to SEQ ID NO: 263736
  misc_feature: GYAE6OF02G6K56.24.53.E09.1.454.CMB.1.raw
  modified_base (281)..(283): a, c, t, g, unknown or other
  misc_feature (281)..(283): n is a, c, g, or t

SEQ ID NO: 264325 - DNA, 430 bp, Homo sapiens
  misc_feature: GYAE6OF02H66RV.24.53.E09.1.454.CMB.1.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (426)..(430): a, c, t, g, unknown or other
  misc_feature (426)..(430): n is a, c, g, or t
tcagactactatgtcacgaccggtgctcgatttagagagagtgtgttgagtttggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatccactgggctccaggctgaggatgagggtnattactacngccagtcgtcgaagatgttcgggcggagggactaagctgaccgtctaggtcagccaaggctcgccccctggcactctcgttcccaccctctcacatagtagtctgagcgggntcggcaaggcncatgnnnnn

SEQ ID NO: 264326 - DNA, 282 bp, Homo sapiens
  misc_feature: GYAE6OF02GFY9Q.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnn

SEQ ID NO: 264327 - DNA, 283 bp, Homo sapiens; identical to SEQ ID NO: 263855
  misc_feature: GYAE6OF02ICOWE.24.53.E09.1.454.CMB.1.raw
  modified_base (281)..(283): a, c, t, g, unknown or other
  misc_feature (281)..(283): n is a, c, g, or t

SEQ ID NO: 264328 - DNA, 439 bp, Homo sapiens
  misc_feature: GYAE6OF02GMQLQ.24.53.E09.1.454.CMB.1.raw
  modified_base (424)..(424): a, c, t, g, unknown or other
  misc_feature (424)..(424): n is a, c, g, or t
  modified_base (430)..(439): a, c, t, g, unknown or other
  misc_feature (430)..(439): n is a, c, g, or t
tcagactactatgtcacgaccggtgctcgatttagagagagtgtgttgggtttgggggctgtttttggaagctgcttgtaccagagggtcaccatctactgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctcggtcactctcgttccccgccctcctcacatagtacgtctgagcgggctggcaaggcncatagnnnnnnnnnn

SEQ ID NO: 264329 - DNA, 451 bp, Homo sapiens
  misc_feature: GYAE6OF02JMPHA.24.53.E09.1.454.CMB.1.raw
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (429)..(451): a, c, t, g, unknown or other
  misc_feature (429)..(451): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtnattacactgccagtcgtcgaagntgttcggcggagggactaagctgaccgtctaggtcagcccaaggctcgcccctggtcactctcgttccccgccctcctcactatacgtagtcctgacgcgggctgggcaaggcgcatagnnnnnnnnnnnnnnnnnnnnnnn

SEQ ID NO: 264330 - DNA, 280 bp, Homo sapiens; identical to SEQ ID NO: 263547
  misc_feature: GYAE6OF02HQZVO.24.53.E09.1.454.CMB.1.raw
  modified_base (279)..(280): a, c, t, g, unknown or other
  misc_feature (279)..(280): n is a, c, g, or t

SEQ ID NO: 264331 - DNA, 294 bp, Homo sapiens
  misc_feature: GYAE6OF02IK9U2.24.53.E09.1.454.CMB.1.raw
  modified_base (284)..(294): a, c, t, g, unknown or other
  misc_feature (284)..(294): n is a, c, g, or t
tcagactactatgtcacgaccggtgctcgatttagagagagtgtgttgggtttgggggtgtggtggtctcctactcccgccttgacggggtctgctatctgcctcgctggccatcacgtgggctccaggctgaggatgagggtgattactactgccagtcgtcgaagatgttcggcggagggactaagctgaccgtcctaggtcagcccaaggctcgccccctcggtcactctgttcccgccctcctcacatagtagtctgagcgggctggcaaggcgcatagnnnnnnnnnnn

SEQ ID NO: 264332 - DNA, 466 bp, Homo sapiens
  misc_feature: GYAE6OF02F2YDU.24.53.E09.1.454.CMB.1.raw
  modified_base (451)..(466): a, c, t, g, unknown or other
  misc_feature (451)..(466): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacacgacccccaaactcctcatttatcgtaacaacaatcggccctcgtggggtccctgaccgattcctccgcctccaagttctggccacctcagcctcgctggccatcactgggctccaggctgagatggagggtgattactactgccagtcgtcgaagatggttcggcggaggactaagctgaccgtccgtagtcacgccgaaggctcgcccctcggtcactctcgtcccaccctcctccacatagtagtcgtgacggcgggtcgtcggacgaacgggcgactagtagcgnnnnnnnnnnnnnnnn

SEQ ID NO: 264333 - DNA, 282 bp, Homo sapiens
  misc_feature: GYAE6OF02GU7S1.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatag

SEQ ID NO: 264334 - DNA, 283 bp, Homo sapiens; identical to SEQ ID NO: 263761
  misc_feature: GYAE6OF02G6UUS.24.53.E09.1.454.CMB.1.raw
  modified_base (280)..(283): a, c, t, g, unknown or other
  misc_feature (280)..(283): n is a, c, g, or t

SEQ ID NO: 264335 - DNA, 438 bp, Homo sapiens
  misc_feature: GYAE6OF02IXE35.24.53.E09.1.454.CMB.1.raw
  modified_base (162)..(162): a, c, t, g, unknown or other
  misc_feature (162)..(162): n is a, c, g, or t
  modified_base (426)..(438): a, c, t, g, unknown or other
  misc_feature (426)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcgcggagggactaagctgaccgtctaggtcagcccaaggctgcccctggtcactctgttccccgccctcctcacatagtacgtctgagcgggctggcaaggcgcagtagnnnnnnnnnnnnn

SEQ ID NO: 264336 - DNA, 561 bp, Homo sapiens
  misc_feature: GYAE6OF02G2I0O.24.53.E09.1.454.CMB.1.raw
  modified_base (297)..(297): a, c, t, g, unknown or other
  misc_feature (297)..(297): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
  modified_base (490)..(490): a, c, t, g, unknown or other
  misc_feature (490)..(490): n is a, c, g, or t
tcagactactatgtcacgaccggtgctcgatttagagagagtgtgttgggtttggggtagggcgttggtccagcctgggggtcccgtgagactctcctgtgcagcctctggattcccctttagtgtactttttggatgacctgggtccgccaggctccagggacggggctggagtgggtggccaatataaggcacgatggacgtagcatgtactatgtggactctgtgaagggccgattcaccatctccagagacaacgccaagaactcactgtatctaggaaatgaccagcctganagtcgagacacggctatgtattactgtgcgaccatatcagcaccgtggacgtcgacatctagaactactccagcagttggggccagggcaccctggtcaccgtcncctcacgcctccgaccaacgggccctagtccggtaccttacccgngccgccctggcctccaaggcgaccacccgtccgagacgcaacnggccgcccgtgggcctcggccttcgggacaacggtaccctacgttcccaacgagttaacgtacgtctacgg

SEQ ID NO: 264337 - DNA, 313 bp, Homo sapiens
  misc_feature: GYAE6OF02FIZDG.24.53.E09.1.454.CMB.1.raw
  modified_base (282)..(313): a, c, t, g, unknown or other
  misc_feature (282)..(313): n is a, c, g, or t
tcagactactatgtcacgaccggtgctcgatttagagagagtgtggttggggtttgggggtgtggtggtctccactcccgccttgacgggctgcctatctgcctcgctggccatcactgggctccaggctgaggatgagggtgattactactgccagtcgtcgaagatgttacggcggaggactaagctgaccgtctaggtccagcccaaggctgccccctggtcactctgttccccaccctcctcacatagtagtctgagcgggctggcaaggcgcatagnnnnnnnnnnnnnnnnnnnnnnnnnnnnnnnn

SEQ ID NO: 264338 - DNA, 434 bp, Homo sapiens
  misc_feature: GYAE6OF02GYIOV.24.53.E09.1.454.CMB.1.raw
  modified_base (419)..(419): a, c, t, g, unknown or other
  misc_feature (419)..(419): n is a, c, g, or t
  modified_base (425)..(434): a, c, t, g, unknown or other
  misc_feature (425)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtcctaggtcagcccaaggctgcccctggtcactctgttccccgccctcctcacatagtagtctgagcgggctggcaaggcncatagnnnnnnnnnn

SEQ ID NO: 264339 - DNA, 441 bp, Homo sapiens
  misc_feature: GYAE6OF02IF3CU.24.53.E09.1.454.CMB.1.raw
  modified_base (431)..(441): a, c, t, g, unknown or other
  misc_feature (431)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagccctcgctggccatcactgggctccaggctgaggatgagggtgattactactgcccagtcgtcgaagatgttcggcggagggactaagctgaccgtctaggtcagcccaaggctcgcccctcggtcactctcgttccccacctcctcacatagtagtctgagcgggctggcaaggcgcatagnnnnnnnnnnn

SEQ ID NO: 264340 - DNA, 437 bp, Homo sapiens
  misc_feature: GYAE6OF02IBIHN.24.53.E09.1.454.CMB.1.raw
  modified_base (162)..(162): a, c, t, g, unknown or other
  misc_feature (162)..(162): n is a, c, g, or t
  modified_base (360)..(360): a, c, t, g, unknown or other
  misc_feature (360)..(360): n is a, c, g, or t
  modified_base (428)..(437): a, c, t, g, unknown or other
  misc_feature (428)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggcngccccctggtcactctgttcccaccctcctcacatagtagtctgagcgggctgggcaaggcgcatagnnnnnnnnnn

SEQ ID NO: 264341 - DNA, 283 bp, Homo sapiens
  misc_feature: GYAE6OF02F11HS.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggatgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnn

SEQ ID NO: 264342 - DNA, 281 bp, Homo sapiens; identical to SEQ ID NO: 264311
  misc_feature: GYAE6OF02GK964.24.53.E09.1.454.CMB.1.raw
  modified_base (280)..(281): a, c, t, g, unknown or other
  misc_feature (280)..(281): n is a, c, g, or t

SEQ ID NO: 264343 - DNA, 280 bp, Homo sapiens; identical to SEQ ID NO: 263488
  misc_feature: GYAE6OF02GHNXW.24.53.E09.1.454.CMB.1.raw
  modified_base (280)..(280): a, c, t, g, unknown or other
  misc_feature (280)..(280): n is a, c, g, or t

SEQ ID NO: 264344 - DNA, 441 bp, Homo sapiens
  misc_feature: GYAE6OF02HBYWH.24.53.E09.1.454.CMB.1.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
  modified_base (430)..(441): a, c, t, g, unknown or other
  misc_feature (430)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggntgagggtgattacactgccagtcgtcgaagntgttcggcggagggactaagctgaccgtcctaggtcagcccaaggctcgcccctggtcactctcgttccccaccctcctcactatacgtgtcngagcgggctggacaaggcgcatagnnnnnnnnnnnn

SEQ ID NO: 264345 - DNA, 280 bp, Homo sapiens; identical to SEQ ID NO: 263488
  misc_feature: GYAE6OF02G058E.24.53.E09.1.454.CMB.1.raw
  modified_base (280)..(280): a, c, t, g, unknown or other
  misc_feature (280)..(280): n is a, c, g, or t

SEQ ID NO: 264346 - DNA, 433 bp, Homo sapiens
  misc_feature: GYAE6OF02F3JRS.24.53.E09.1.454.CMB.1.raw
  modified_base (428)..(433): a, c, t, g, unknown or other
  misc_feature (428)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggcccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatgnnnnnn

SEQ ID NO: 264347 - DNA, 280 bp, Homo sapiens; identical to SEQ ID NO: 263573
  misc_feature: GYAE6OF02HFSR3.24.53.E09.1.454.CMB.1.raw
  modified_base (280)..(280): a, c, t, g, unknown or other
  misc_feature (280)..(280): n is a, c, g, or t

SEQ ID NO: 264348 - DNA, 280 bp, Homo sapiens; identical to SEQ ID NO: 264198
  misc_feature: GYAE6OF02FWBSF.24.53.E09.1.454.CMB.1.raw
  modified_base (280)..(280): a, c, t, g, unknown or other
  misc_feature (280)..(280): n is a, c, g, or t

SEQ ID NO: 264349 - DNA, 445 bp, Homo sapiens
  misc_feature: GYAE6OF02I6QGC.24.53.E09.1.454.CMB.1.raw
  modified_base (428)..(445): a, c, t, g, unknown or other
  misc_feature (428)..(445): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgacccgattctccgcctccaagtctggcacctcagcctcgctggccatcactgggctccaggctgaggatgagggtgattactactgccagtcgtcgaagatgttcggcggaggactaagctgaccgtcaggtcagccaaggctcgcccctggtccactctcgttccccaccctcctcacactgtatctgacggcggctggcgaaggccgcatagnnnnnnnnnnnnnnnnnn

SEQ ID NO: 264350 - DNA, 436 bp, Homo sapiens
  misc_feature: GYAE6OF02JC9QR.24.53.E09.1.454.CMB.1.raw
  modified_base (430)..(436): a, c, t, g, unknown or other
  misc_feature (430)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacgagcagcttccaaaaacagcccccaaactcctcatttatcgtaacaacaattggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttcccgccctcctcacatagtagtctggacgcgggctgggcaaggcgcatagnnnnnnn

SEQ ID NO: 264351 - DNA, 281 bp, Homo sapiens; identical to SEQ ID NO: 263461
  misc_feature: GYAE6OF02H021V.24.53.E09.1.454.CMB.1.raw
  modified_base (280)..(281): a, c, t, g, unknown or other
  misc_feature (280)..(281): n is a, c, g, or t

SEQ ID NO: 264352 - DNA, 283 bp, Homo sapiens
  misc_feature: GYAE6OF02G0ODQ.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctcggtcactctgttccccaccctcctcacatagtagtctgagcgggctggcaaggcgcatagnnnn

SEQ ID NO: 264353 - DNA, 441 bp, Homo sapiens
  misc_feature: GYAE6OF02G6679.24.53.E09.1.454.CMB.1.raw
  modified_base (288)..(288): a, c, t, g, unknown or other
  misc_feature (288)..(288): n is a, c, g, or t
  modified_base (432)..(441): a, c, t, g, unknown or other
  misc_feature (432)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatgttcggcggagggactaagctgaccgtcctaggtcagcccaaggctcgccccctggtcactctcgttccccgccctcctcacatagtacgtctgagcgggctgggcaaggccgcatagnnnnnnnnnn

SEQ ID NO: 264354 - DNA, 281 bp, Homo sapiens; identical to SEQ ID NO: 263461
  misc_feature: GYAE6OF02IENRO.24.53.E09.1.454.CMB.1.raw
  modified_base (280)..(281): a, c, t, g, unknown or other
  misc_feature (280)..(281): n is a, c, g, or t

SEQ ID NO: 264355 - DNA, 431 bp, Homo sapiens
  misc_feature: GYAE6OF02G8XES.24.53.E09.1.454.CMB.1.raw
  modified_base (426)..(431): a, c, t, g, unknown or other
  misc_feature (426)..(431): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnnnnn

SEQ ID NO: 264356 - DNA, 860 bp, Homo sapiens
  misc_feature: GYAE6OF02G5O2R.24.53.E09.1.454.CMB.1.raw
  modified_base (754)..(754): a, c, t, g, unknown or other
  misc_feature (754)..(754): n is a, c, g, or t
tcagactactatgtcacgaccggtgctcgatttagagagagtgtggtaggggttggggctgttttggaagctgcgttgtaccagagggtcaccgatctcctggccactggagcaacagtcgcgcagtttgatggtccacgtggtacgaagcagtcttaccaaaaacagtcccccaaatcctcactttatccgtaacaactaactccggcctcgtggggtccctagaccgtagttcggtccgcctaccaaggttcctcgggacctacctcgtacggccccgttcgacgttcgggacctaacttacctacgtacgggtaccttaccgtaaaggtccgttaggaacgggacgtagggaacggggttaccggtaaactttaccccgtaaccgtccggtaccccgtaaggttccgttaccgtaaaagtgttcgggttccgggacgggtaacgggtaaccttaaagggaccgttcgggtaacccccgttaccgttaacgggttacccgaacggtaccccggtaaagggggtcccgttaccgggtacccccccgtttgggggttaacccgtaaacccggtttacccggtttacccggggtttttccccccccggacccctttaccccgttaccctaaaacccgtaagtttaaccgggtaaaccggtttcccgttaagggaaccgggtcccgggggtccttaacggggacccgtaaagggggtacccgtacttaacgttaacggaacttacgtagacgtaanacgtacgtacgtaccgtaccgtacgtacgtcgtacgacgacgacgacgacgacgtacgtacgtacgtacgacgcgtcgtacgtactacgtcgtcgtcgtctcgtcg

SEQ ID NO: 264357 - DNA, 282 bp, Homo sapiens
  misc_feature: GYAE6OF02F7FCL.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcaaagatgttcggcggagggactaagctgaccgtcctaggtcagcccaaggctgccccctcggtcactctgttccccgccctcctcacatagtagtctgagcgggctggcaaggcgcatagnn

SEQ ID NO: 264358 - DNA, 438 bp, Homo sapiens
  misc_feature: GYAE6OF02HCZQG.24.53.E09.1.454.CMB.1.raw
  modified_base (430)..(438): a, c, t, g, unknown or other
  misc_feature (430)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctcggtcactctcgttccccaccctcctcacatagtagtctgacgcgggctgggcaaggcgcatagnnnnnnnnn

SEQ ID NO: 264359 - DNA, 282 bp, Homo sapiens; identical to SEQ ID NO: 263549
  misc_feature: GYAE6OF02G2ECW.24.53.E09.1.454.CMB.1.raw
  modified_base (281)..(282): a, c, t, g, unknown or other
  misc_feature (281)..(282): n is a, c, g, or t

SEQ ID NO: 264360 - DNA, 471 bp, Homo sapiens
  misc_feature: GYAE6OF02HQOC8.24.53.E09.1.454.CMB.1.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (445)..(445): a, c, t, g, unknown or other
  misc_feature (445)..(445): n is a, c, g, or t
  modified_base (447)..(471): a, c, t, g, unknown or other
  misc_feature (447)..(471): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcattttatcgtaaacaacaatcggccctctggggtcccctgaccgattcctccgcctccaagtctggcacctcagcctcgctggccatcactgggctccaggctgaggatgaggtgattactactgccagtcgtcgaagntgtcggnggaggactagctgaccgtcaggtcagcccaaggctcgcccctggtcactctcgttccccgcccttcctcactagtagtacgtctaggacgcgggctgggccgaagggccgacaagtacggnannnnnnnnnnnnnnnnnnnnnnnnn

SEQ ID NO: 264361 - DNA, 288 bp, Homo sapiens
  misc_feature: GYAE6OF02GRB9Q.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctcggtcactctgttccccgccctcctcacatagtagtctgagcgggctggcaaggcgcatagnnnnnnnnn

SEQ ID NO: 264362 - DNA, 691 bp, Homo sapiens
  misc_feature: GYAE6OF02HMG37.24.53.E09.1.454.CMB.1.raw
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
tcagactactatgtcacgaccggtgctcgatttagagagagtgtgttggggttttggggggctgttttggaacgctgcgttgtaccagagggtcaccgatctcctggccactgggagcaacagtcggcgcaggttttgatgtccgactcggtacaagcagcttccaaaaaacagccccccaaaattcctccattttactccgtaaacaaccaactcggccctctggggtccctgaccgtagttctccgcctccaagtcctggccacctcgacggcctcgctggccatcacgtggcttccaggctggagatggaggtagaacttacgacgtcgcccctaggtccgtacggaaagtagttcggtttacgggcgggtaacggggtaacctaaaggccttacgggtaacccgtttccgtaagggttaccgaacgggtacccccaaaggggtccctaccgggtccccccgttaggggttccaaccttcgttccgttcccccaacccgttcccgtacgaactaagttaacgttacgttaccgttacggacgtcgggtacttcgggaccgtaacgggccgctaagtacgncgtangtntgtatacgttatgtgtanacgtntacgtctaacgtccgtagtacgtacgtcggcgtacggacgtaggtacgtaagaccgtaacggcgtagtcgcgtcgac

SEQ ID NO: 264363 - DNA, 503 bp, Homo sapiens
  misc_feature: GYAE6OF02GVHFO.24.53.E09.1.454.CMB.1.raw
  modified_base (403)..(403): a, c, t, g, unknown or other
  misc_feature (403)..(403): n is a, c, g, or t
  modified_base (499)..(499): a, c, t, g, unknown or other
  misc_feature (499)..(499): n is a, c, g, or t
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagctgggttttccttgttgctattttagaaggtgtccagtgtgaggtgcaactggtggagtctgggggaggcttggtccagcctggggggtccctgagactctcctgtgcagcctctggacttcccctttagtgacttttggatgacctgggtccgcaggctccgagggacgggctggagtgggtgccaatataaggcacgatggacgtagcatgtactatgtgactctgtgaagggcgatcaccatctcaganacacgccagactcactgtatcagaatcgaccagcctagagagtcgagacacgctatgtattactgtcgacacatactcacgctaccgtggactcgntacg

SEQ ID NO: 264364 - DNA, 437 bp, Homo sapiens
  misc_feature: GYAE6OF02JRDH7.24.53.E09.1.454.CMB.1.raw
  modified_base (159)..(159): a, c, t, g, unknown or other
  misc_feature (159)..(159): n is a, c, g, or t
  modified_base (292)..(292): a, c, t, g, unknown or other
  misc_feature (292)..(292): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (424)..(437): a, c, t, g, unknown or other
  misc_feature (424)..(437): n is a, c, g, or t
tcagactactatgtcacgaccggtgctcgatttagagagagtgtgttgggtttggggctgttttggaagctgcttgtaccagaggtcaccatctcctgcactgggagcaacatcggcgcaggttttgatgtccactggtacaagcagcttccaaaaacngccccccaaatcctcatttactcgtaacaacaatcggccctctggggtccctgaccgattcctcccgcctccaagtctggccacctcacgccctcgcctggccatcactggctccaggctgaggatgagggtnattacactgccagtccgtacgaagatcggtcggcggaggactagctgaccgtctaggtcacgccaagctcgcccctgtcactctctcccaccctcncacntagtactcngacgcggctggcaggcncatagnnnnnnnnnnnnnn

SEQ ID NO: 264365 - DNA, 280 bp, Homo sapiens; identical to SEQ ID NO: 263573
  misc_feature: GYAE6OF02GAPAC.24.53.E09.1.454.CMB.1.raw
  modified_base (280)..(280): a, c, t, g, unknown or other
  misc_feature (280)..(280): n is a, c, g, or t

SEQ ID NO: 264366 - DNA, 318 bp, Homo sapiens
  misc_feature: GYAE6OF02HL7MP.24.53.E09.1.454.CMB.1.raw
  modified_base (281)..(318): a, c, t, g, unknown or other
  misc_feature (281)..(318): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcaggcccaaggctgccccctggtcactctgttccccaccctcctcacatagtagtctgagcgggctggcaaggcgcatagnnnnnnnnnnnnnnnnnnnnnnnnnnnnnnnnnnnnnn

SEQ ID NO: 264367 - DNA, 282 bp, Homo sapiens; identical to SEQ ID NO: 263549
  misc_feature: GYAE6OF02F0DBF.24.53.E09.1.454.CMB.1.raw
  modified_base (281)..(282): a, c, t, g, unknown or other
  misc_feature (281)..(282): n is a, c, g, or t

SEQ ID NO: 264368 - DNA, 453 bp, Homo sapiens
  misc_feature: GYAE6OF02IWC62.24.53.E09.1.454.CMB.1.raw
  modified_base (162)..(162): a, c, t, g, unknown or other
  misc_feature (162)..(162): n is a, c, g, or t
  modified_base (291)..(291): a, c, t, g, unknown or other
  misc_feature (291)..(291): n is a, c, g, or t
  modified_base (390)..(390): a, c, t, g, unknown or other
  misc_feature (390)..(390): n is a, c, g, or t
  modified_base (431)..(453): a, c, t, g, unknown or other
  misc_feature (431)..(453): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggccacctcagcctcgctggccatcactgggctccaggctgaggatgagggtnattctactgccagtcgtcgaagatgtcggcggaggactaagctgaccgtctaggtcagcccaaggctcgccccctggtcactctcgttcccgcccttcncacatagtagtctggacgcgggctggcaaggcgcatagcgnnnnnnnnnnnnnnnnnnnnnnn

SEQ ID NO: 264369 - DNA, 577 bp, Homo sapiens
  misc_feature: GYAE6OF02HK30P.24.53.E09.1.454.CMB.1.raw
  modified_base (352)..(352): a, c, t, g, unknown or other
  misc_feature (352)..(352): n is a, c, g, or t
  modified_base (457)..(457): a, c, t, g, unknown or other
  misc_feature (457)..(457): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctcagagacaacgccagaaacacactgtatctgcaaatgagcagcctgaaagccgacgacacggctgtgtattactgtgcaagaggggccagcattactcctactactccgntatggacgtcgtggggccaaaggggccagggtcaccgtctcctcagccctccaccaacgggcccacgtcggtccttccccctggccacccctccctccaacgacnccacctcgtcgggggccacgacggccggcccgtcggggcctcggcccgttggtccgaaacggtaccttaaccgttcccaacaattacgtaagtcctggaggccgggtcgtgggcaacggg

SEQ ID NO: 264370 - DNA, 280 bp, Homo sapiens; identical to SEQ ID NO: 263488
  misc_feature: GYAE6OF02H6FP8.24.53.E09.1.454.CMB.1.raw
  modified_base (280)..(280): a, c, t, g, unknown or other
  misc_feature (280)..(280): n is a, c, g, or t

SEQ ID NO: 264371 - DNA, 280 bp, Homo sapiens
  misc_feature: GYAE6OF02H6AWY.24.53.E09.1.454.CMB.1.raw
  modified_base (277)..(280): a, c, t, g, unknown or other
  misc_feature (277)..(280): n is a, c, g, or t
tcagactactatgtcacgaccggtgctcgatttagagagagtgtgttggttttggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaaggctgccccctggtcactctgttcccaccctctcacatagtagtctgagcgggctggcaaggcgcatagnnnn

SEQ ID NO: 264372 - DNA, 305 bp, Homo sapiens
  misc_feature: GYAE6OF02I7QT6.24.53.E09.1.454.CMB.1.raw
  modified_base (284)..(284): a, c, t, g, unknown or other
  misc_feature (284)..(284): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgagatgaggtnattactactgccagtctcgaa

SEQ ID NO: 264373 - DNA, 283 bp, Homo sapiens
  misc_feature: GYAE6OF02HL0CK.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttcccaccctcctcacatagtagtctgagcgggctggcaaggcgcatagnnn

SEQ ID NO: 264374 - DNA, 296 bp, Homo sapiens
  misc_feature: GYAE6OF02IM2WV.24.53.E09.1.454.CMB.1.raw
  modified_base (283)..(296): a, c, t, g, unknown or other
  misc_feature (283)..(296): n is a, c, g, or t
tcagactactatgtcacgaccggtgctcgatttagagagagtgtgttgggtttgggggtgtggtggtctccactcccgccttgacggggctgctatcctgcctcgctggccatcactgggctccaggctgaggatgagggtgattactactgtccagtcgtcgaagatgttcggcggagggactaagctgaccgtcctaggtcagcccaaggctgccccctggtcactctgttcccaccctcctcacatagtagtctgagcgggactaggcaaggcgcatagnnnnnnnnnnnnnn

SEQ ID NO: 264375 - DNA, 351 bp, Homo sapiens
  misc_feature: GYAE6OF02HHT7E.24.53.E09.1.454.CMB.1.raw
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (289)..(351): a, c, t, g, unknown or other
  misc_feature (289)..(351): n is a, c, g, or t
tcagactactatgtcacgaccggtgctcgattttagagagagtgtgttgggggtttgggggtgtggtggtctccactcccgccttgacggggctgctatctcgcctcgctcggccatcactgggctccaggctgaggatcgagggtgattactactgccagtcgtcgaaggatgttcggcggagggactaagctgaccgtcctaggtcagcccaaggcgtcgcccctggtcactctgttcccgccttcctcanatagtagtctgagcgggactggcaaggcncataggnnnnnnnnnnnnnnnnnnnnnnnnnnnnnnnnnnnnnnnnnnnnnnnnnnnnnnnnnnnnnnn

SEQ ID NO: 264376 - DNA, 438 bp, Homo sapiens
  misc_feature: GYAE6OF02I1NPB.24.53.E09.1.454.CMB.1.raw
  modified_base (415)..(415): a, c, t, g, unknown or other
  misc_feature (415)..(415): n is a, c, g, or t
  modified_base (421)..(438): a, c, t, g, unknown or other
  misc_feature (421)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattacactgcccagtcgtcgaagatgttcggcggaggactaagctgaccgtctaggtcagcccaaggctgcccctggcactctcgtcccacctcctcacatagtatctgacgcgggctggcaaggcncatagnnnnnnnnnnnnnnnnnn

SEQ ID NO: 264377 - DNA, 460 bp, Homo sapiens
  misc_feature: GYAE6OF02GOKIB.24.53.E09.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(460): a, c, t, g, unknown or other
  misc_feature (431)..(460): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctntggggtccctgaccgattctccgcctccaagtctggcacctcagcctcgctggccatcactgggctccaggctgaggatgagggtnattactatgccagtcgtcgaagatggtcggnggagggactaagctgaccgtctaggtcacgccaaggctcgcccctggcactctgtccccnccctctcacatacgtagtctgacgcgggactggcaaggcncatagnancnnnnnnnnnnnnnnnnnnnnnnnnnnnnnn

SEQ ID NO: 264378 - DNA, 437 bp, Homo sapiens
  misc_feature: GYAE6OF02IFGHT.24.53.E09.1.454.CMB.1.raw
  modified_base (424)..(424): a, c, t, g, unknown or other
  misc_feature (424)..(424): n is a, c, g, or t
  modified_base (430)..(437): a, c, t, g, unknown or other
  misc_feature (430)..(437): n is a, c, g, or t
tcagactactatgtcacgaccggtgctcgatttagagagagtgtgttgagtttggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtcccctgaccgattctccgcctccaagtctggcacctcagcctcgctggccatcactgggctccaggctgagatgagggtgattactactgccagtcgtcgaagatgttcggcggagggactaagctgaccgtcctaggtcagacccaaggcctgccccctggtcactctcgttccccacctcctcacatagtacgtctgagcgggctggcaaggcncatagnnnnnnnn

SEQ ID NO: 264379 - DNA, 288 bp, Homo sapiens
  misc_feature: GYAE6OF02F9TQH.24.53.E09.1.454.CMB.1.raw
  modified_base (276)..(276): a, c, t, g, unknown or other
  misc_feature (276)..(276): n is a, c, g, or t
  modified_base (282)..(288): a, c, t, g, unknown or other
  misc_feature (282)..(288): n is a, c, g, or t
tcagactactatgtcacgaccggtgctcgatttagagagagtgtgttgggtttgggggtgtggtggtctccactcccgccttgacggggctgctatctgcctcgctggccatcactggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcncatagnnnnnnn

SEQ ID NO: 264380 - DNA, 282 bp, Homo sapiens; identical to SEQ ID NO: 264326
  misc_feature: GYAE6OF02G48LK.24.53.E09.1.454.CMB.1.raw
  modified_base (281)..(282): a, c, t, g, unknown or other
  misc_feature (281)..(282): n is a, c, g, or t

SEQ ID NO: 264381 - DNA, 442 bp, Homo sapiens
  misc_feature: GYAE6OF02G83CN.24.53.E09.1.454.CMB.1.raw
  modified_base (432)..(442): a, c, t, g, unknown or other
  misc_feature (432)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctgttccccaccctcctcacatagtagtctgacgcgggctggcaagggcgcatagnnnnnnnnnnn

SEQ ID NO: 264382 - DNA, 481 bp, Homo sapiens
  misc_feature: GYAE6OF02HAL34.24.53.E09.1.454.CMB.1.raw
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (453)..(481): a, c, t, g, unknown or other
  misc_feature (453)..(481): n is a, c, g, or t
tcagactactatgtcacgaccggtgctcgatttagagagagtgtgttggggtttgggggctgttttggaagctgcttgtaccagaggggtctaccatcttcctgcactgggagcaaacatcggcgcaggttttgatgtccactggtacaagcagcttccaaaaactcgccccccaaaatcctctaagtttatccgtaaacaacaatcggccctntgggggtcccctggaccgattcctccggcctccaagtctggccaccgtcagcctcgctggccatccactggctcaggctgagatgagggtnattacactgccgagtcgtcgaagatggtacgggnggagggactagctggaccgtctagggtcagcccgaaggctcgcccctgtcacgtctcgttccccacctcctacgactactagtctctgaggcgggctggacaaggcgcaatgannnnnnnnnnnnnnnnnnnnnnnnnnnnn

SEQ ID NO: 264383 - DNA, 433 bp, Homo sapiens
  misc_feature: GYAE6OF02GNMEZ.24.53.E09.1.454.CMB.1.raw
  modified_base (285)..(285): a, c, t, g, unknown or other
  misc_feature (285)..(285): n is a, c, g, or t
  modified_base (378)..(378): a, c, t, g, unknown or other
  misc_feature (378)..(378): n is a, c, g, or t
  modified_base (423)..(433): a, c, t, g, unknown or other
  misc_feature (423)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggccatcactggctccaggctgaggatgaggtnattactactgccagtcgtcgaagatgttcggcggaggactaagctgaccgtctaggtcagcccaaggctcgcccctggtcactctcgttcccnccctctccacatacgtagtctgagcgggctggcaaggcgcatagnnnnnnnnnnn

SEQ ID NO: 264384 - DNA, 459 bp, Homo sapiens
  misc_feature: GYAE6OF02JWDFC.24.53.E09.1.454.CMB.1.raw
  modified_base (387)..(387): a, c, t, g, unknown or other
  misc_feature (387)..(387): n is a, c, g, or t
  modified_base (442)..(459): a, c, t, g, unknown or other
  misc_feature (442)..(459): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtacgaagatggttcggcggagggactaagctgaccgtctaggtcagcccaaggctcgccccctggtcactctcgttcccnccctcctcacatacgtactctggacgcgggctcggacaacgggcgaccaagtgcnnnnnnnnnnnnnnnnnn

SEQ ID NO: 264385 - DNA, 384 bp, Homo sapiens
  misc_feature: GYAE6OF02HGFGS.24.53.E09.1.454.CMB.1.raw
  modified_base (376)..(384): a, c, t, g, unknown or other
  misc_feature (376)..(384): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgttcccgccctcctcacatagtagtctgagcgggctggcaaggcgcatagnnnnnnnnn

SEQ ID NO: 264386 - DNA, 438 bp, Homo sapiens
  misc_feature: GYAE6OF02F8A64.24.53.E09.1.454.CMB.1.raw
  modified_base (390)..(390): a, c, t, g, unknown or other
  misc_feature (390)..(390): n is a, c, g, or t
  modified_base (428)..(438): a, c, t, g, unknown or other
  misc_feature (428)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttccccaccctccncacatagtagtctgagcgggctgggcaaggcgcatagnnnnnnnnnnn

SEQ ID NO: 264387 - DNA, 353 bp, Homo sapiens
  misc_feature: GYAE6OF02GAG0C.24.53.E09.1.454.CMB.1.raw
  modified_base (149)..(149): a, c, t, g, unknown or other
  misc_feature (149)..(149): n is a, c, g, or t
  modified_base (174)..(174): a, c, t, g, unknown or other
  misc_feature (174)..(174): n is a, c, g, or t
  modified_base (292)..(292): a, c, t, g, unknown or other
  misc_feature (292)..(292): n is a, c, g, or t
  modified_base (299)..(301): a, c, t, g, unknown or other
  misc_feature (299)..(301): n is a, c, g, or t
  modified_base (303)..(353): a, c, t, g, unknown or other
  misc_feature (303)..(353): n is a, c, g, or t
tcagactactatgtcacgaccggtgctcgatttagagagagtgtgttggggtttggggggtgtggtggtcttccactcccgtcctttgacggggctgctatctgcctcgctggccatcactgggcgtccaggctgaggatggaggggtnattactactgcccagtcgtcgaagntgttcggcggagggactaaggctgaccgtctagggtcaggcccaaggctcgccccctgggtcactctgttccccaccctctcacatagagtctgagccgggctgggacctaagggccnctatagnnngnnnnnnnnnnnnnnnnnnnnnnnnnnnnnnnnnnnnnnnnnnnnnnnnnnn

SEQ ID NO: 264388 - DNA, 434 bp, Homo sapiens
  misc_feature: GYAE6OF02IIGMC.24.53.E09.1.454.CMB.1.raw
  modified_base (430)..(434): a, c, t, g, unknown or other
  misc_feature (430)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaaacagccccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtcacttctcgttcccaccctcctcacatagtagtctgagcgggctggcaaggcgcatagnnnnn

SEQ ID NO: 264389 - DNA, 522 bp, Homo sapiens
  misc_feature: GYAE6OF02HEOK9.24.53.E09.1.454.CMB.1.raw
  modified_base (498)..(522): a, c, t, g, unknown or other
  misc_feature (498)..(522): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatccggccctctggggtccctgaccgattctccgcctccaagtctggcacctcagcctcgctggccatcactgggctccaggctgaggatggagggtgtactactgcacgtgtcgtacgagtgttcggtcgggacgggagtaacgtagcgtaccggtaccgttacggtacgtcgaccgaccggacggtcgtccccgtccccgtcggtacctaccgttcgttccccgtcccccgtccccttctaccacttacgtacgttcgtcgaggcgggcggtcggtcggaacggacggccgacgtagtagcnnnnnnnnnnnnnnnnnnnnnnnnn

SEQ ID NO: 264390 - DNA, 442 bp, Homo sapiens
  misc_feature: GYAE6OF02JCTSL.24.53.E09.1.454.CMB.1.raw
  modified_base (427)..(442): a, c, t, g, unknown or other
  misc_feature (427)..(442): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatccactggctccaggctgagatgagggtgattactactgccagtcgtcgaagatgtcggcggagggactagctgaccgtcctaggtcagcccaaggcctcgccccctggtcactctcgttccccaccctcctcactatagtagtctgagcggctggcaaggcgcatagnnnnnnnnnnnnnnnn

SEQ ID NO: 264391 - DNA, 432 bp, Homo sapiens
  misc_feature: GYAE6OF02JAW5M.24.53.E09.1.454.CMB.1.raw
  modified_base (419)..(419): a, c, t, g, unknown or other
  misc_feature (419)..(419): n is a, c, g, or t
  modified_base (425)..(432): a, c, t, g, unknown or other
  misc_feature (425)..(432): n is a, c, g, or t
tcagactactatgtcacgaccggtgctcgatttagagagagtgtgttgggtttgggggctgtttttggaagctgcttgtaccagagggtcaccatctccttcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtgattacactgccagtcgtcgaagatggttcggcggagggactaagctgaccgtctaggtcagcccaaggctcgccccctggtcactctcgtcccaccctcctcacatgtagctgagcgggctggcaggcncatagnnnnnnnn

SEQ ID NO: 264392 - DNA, 283 bp, Homo sapiens
  misc_feature: GYAE6OF02G2UBW.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttccccaccctcctcacatagtagtctgagcgggctggcaaggcgcatagnnnn

SEQ ID NO: 264393 - DNA, 617 bp, Homo sapiens
  misc_feature: GYAE6OF02J16IB.24.53.E09.1.454.CMB.1.raw
  modified_base (169)..(169): a, c, t, g, unknown or other
  misc_feature (169)..(169): n is a, c, g, or t
  modified_base (320)..(320): a, c, t, g, unknown or other
  misc_feature (320)..(320): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (558)..(559): a, c, t, g, unknown or other
  misc_feature (558)..(559): n is a, c, g, or t
  modified_base (612)..(612): a, c, t, g, unknown or other
  misc_feature (612)..(612): n is a, c, g, or t
tcagactactatgtcacgaccggtgctcgatttagagagagtgtgttggtaggtttggggcgtgttttggtaggcgtgcttgtaccagagggtctaccgactctcctgtcactcggacgcaacatcggcgcaggtttgatgtccactggtacagcagcttccaaaaacncgcccccaaactcctccactttagccgtaaccaacgaatccggccctcaggggtccctgaccgtattctccgcctccaagtctggcaccgtcacgcctcgactcggccatccgactggctccaggctgacgatgaggtcgatacgacgtcncgtatcgacgaagtagttagttcgggacggaagggactaaaggccgtacgaacccggttaccgtaaagggggtccaacggtccccgaaaggggtccctttcggcccccgttaacggggtcctaaccgttccgtcggttttacccccggacccttaccgccgtaacgtacgtacgttacgtcgtacggacgccgggtctcggtacgaacggtcgtacgacgtagtcgagcngactnacnngcgcgcgcgcgtgtgtgtcgtcgtcgcgcgcgcgcgcgcgcgcgcgacgcgcncgtcg

SEQ ID NO: 264394 - DNA, 281 bp, Homo sapiens; identical to SEQ ID NO: 263523
  misc_feature: GYAE6OF02F2DF0.24.53.E09.1.454.CMB.1.raw
  modified_base (281)..(281): a, c, t, g, unknown or other
  misc_feature (281)..(281): n is a, c, g, or t

SEQ ID NO: 264395 - DNA, 563 bp, Homo sapiens
  misc_feature: GYAE6OF02G8B2C.24.53.E09.1.454.CMB.1.raw
  modified_base (317)..(317): a, c, t, g, unknown or other
  misc_feature (317)..(317): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcacagaactcactgtatctggaaatgaccagcctgagagtcgaggacacggctatgtattacngtgcgaccatatcagcacctggagtcgcatctagaactacttccagcagttggggccagggccacccgtggtccaccgtctccctcacgcctccaccgacggccctacgtccggtcccttcccccgtcggtcccgcccgtcgccctaccacggacaccgacctcccgagacgccacgacggccgcccgtcgggcctcggccgtcggtaccaacggaccttaccgtacccgacaacttacgtagtcg

SEQ ID NO: 264396 - DNA, 558 bp, Homo sapiens
  misc_feature: GYAE6OF02JK1IN.24.53.E09.1.454.CMB.1.raw
  modified_base (465)..(465): a, c, t, g, unknown or other
  misc_feature (465)..(465): n is a, c, g, or t
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcagttggggccagggccacccgtggtccaccgtcctccctcacgccctccaccaacgggccccagttccggtccttccccgtggcccgccctcgcctccacggcnccacctccgagacgcacgcgccggccctgggcctcggcctcgggtaccaagggtacctaccgttacccacgtacgttacgtacgtcctacggg

SEQ ID NO: 264397 - DNA, 515 bp, Homo sapiens
  misc_feature: GYAE6OF02JAWZA.24.53.E09.1.454.CMB.1.raw
  modified_base (406)..(406): a, c, t, g, unknown or other
  misc_feature (406)..(406): n is a, c, g, or t
tcagactactatgtcacgaccggtgctcgatttagagagagtgtgttgggtttggaggtctcagagaggagccttagccctggagtccaaggcctttccacttggtgatcagcactgagcacagaggactcaccatggaattggggctgagctgggttttccttgttgctattttagaaggtgtccagtgtgaggtgcaactggtggagtctgggggaggcttggtccagcctggggggtccctgagactctcctgtgcagcctctggattcccctttagtgacttttggatgacctgggtccgccaggctccgaggggacggggctgggagtggggtggccaatataaggcacgatggacgtagcatgtactatgtggactctgtgaagggccgattcaccatcnccagagacaacgcccagacctcactgtatctagaaatgaccagcctgagagtcgagacacggctatgtattacgtgtgccgacatactcagcaccgtggacgtcgctac

SEQ ID NO: 264398 - DNA, 433 bp, Homo sapiens
  misc_feature: GYAE6OF02G1I7T.24.53.E09.1.454.CMB.1.raw
  modified_base (420)..(420): a, c, t, g, unknown or other
  misc_feature (420)..(420): n is a, c, g, or t
  modified_base (426)..(433): a, c, t, g, unknown or other
  misc_feature (426)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgtcggcggaggactaagctgaccgtcctaggtcagcccaaggctcgcccctggtcactctcgttcccaccctcctcacatagtagtctgagcgggctggcaagggcncatagnnnnnnnn

SEQ ID NO: 264399 - DNA, 379 bp, Homo sapiens
  misc_feature: GYAE6OF02GIXOE.24.53.E09.1.454.CMB.1.raw
  modified_base (374)..(379): a, c, t, g, unknown or other
  misc_feature (374)..(379): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccacctcctcacatagtagtctgagcgggctggcaaggcgcatagnnnnnn

SEQ ID NO: 264400 - DNA, 283 bp, Homo sapiens; identical to SEQ ID NO: 263736
  misc_feature: GYAE6OF02IUEQ0.24.53.E09.1.454.CMB.1.raw
  modified_base (281)..(283): a, c, t, g, unknown or other
  misc_feature (281)..(283): n is a, c, g, or t

SEQ ID NO: 264401 - DNA, 434 bp, Homo sapiens
  misc_feature: GYAE6OF02IK2I2.24.53.E09.1.454.CMB.1.raw
  modified_base (425)..(434): a, c, t, g, unknown or other
  misc_feature (425)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtctaggtcagcccaaggctcgcccctggtcactctcgttcccaccctcctcacatagtagtctgagcgggctggcaaggcgcatagnnnnnnnnnn

SEQ ID NO: 264402 - DNA, 281 bp, Homo sapiens
  misc_feature: GYAE6OF02FQDGZ.24.53.E09.1.454.CMB.1.raw
  modified_base (281)..(281): a, c, t, g, unknown or other
  misc_feature (281)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagn

SEQ ID NO: 264403 - DNA, 558 bp, Homo sapiens
  misc_feature: GYAE6OF02GHWL8.24.53.E09.1.454.CMB.1.raw
  modified_base (441)..(441): a, c, t, g, unknown or other
  misc_feature (441)..(441): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggatcgcatctgaatacttccagcagttggggccagggccacccgtggtccacccgtctccctcacgccctcccaccgaacggcccagttccgtcccttcccccgnggcccgccctcgcctccgaggacgccacccgtccgagacgcacacgccggcccgtgggcctggcccgtcggtaccgaacggtaccttaccttcccactagtacggtacgtctacggg

SEQ ID NO: 264404 - DNA, 601 bp, Homo sapiens
  misc_feature: GYAE6OF02I606X.24.53.E09.1.454.CMB.1.raw
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
tcagactactatgtcacgaccggtgctcgatttagagagagtgtgttgggtttggggaggcttagggtccagcctggggggtccctgagacctctcctgtgcagccctctggattcccctttagtgactttttggatgacctgggtccgccaggctccagggacgggctggagtgggtggccaatataaggcacgatcggacgtagctatgtactagtgtggactctgtgaagggccattcaccatctccaganacaacgcccagaactcactgtatctaggaaatgaccagccctgagagtcgaggacacggctatgtattactgtcgcgacctatatcagcaccgtggagtcgcatcagaattacttcgancatttcggggccagggccacccgtcggtaccacccggttctccctcgacgccctaccgaaccgaacggtccccagttccggttccttccccgtggccncccgtgccttccgaggacnccgtaccgtcgacgacgcctacgacggccggacccgtgggaccgtcggccgttacgggtaccaacggtacccgttaccgttcccgaacgacgttacggtacgtacgtacgg

SEQ ID NO: 264405 - DNA, 436 bp, Homo sapiens
  misc_feature: GYAE6OF02H42N5.24.53.E09.1.454.CMB.1.raw
  modified_base (428)..(436): a, c, t, g, unknown or other
  misc_feature (428)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaaactcctcattttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtctaggtcagcccaaggctgccccctggtcactctgttcccaccctctcacatagtagtctgagcgggctggcaaggcgcatagnnnnnnnnn

SEQ ID NO: 264406 - DNA, 302 bp, Homo sapiens
  misc_feature: GYAE6OF02HROZ3.24.53.E09.1.454.CMB.1.raw
  modified_base (282)..(302): a, c, t, g, unknown or other
  misc_feature (282)..(302): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagttcgtcgaagatgtttcggcggagggactaagctgaccgtcctaggtcagcccaaggctgccccctggtcactctgttcccgccctcctcacatgtagtctgagcgggctggccaaggcgcatagnnnnnnnnnnnnnnnnnnnnn

SEQ ID NO: 264407 - DNA, 286 bp, Homo sapiens
  misc_feature: GYAE6OF02GDS79.24.53.E09.1.454.CMB.1.raw
  modified_base (280)..(286): a, c, t, g, unknown or other
  misc_feature (280)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnnnn

SEQ ID NO: 264408 - DNA, 302 bp, Homo sapiens
  misc_feature: GYAE6OF02ISN13.24.53.E09.1.454.CMB.1.raw
  modified_base (273)..(273): a, c, t, g, unknown or other
  misc_feature (273)..(273): n is a, c, g, or t
  modified_base (279)..(302): a, c, t, g, unknown or other
  misc_feature (279)..(302): n is a, c, g, or t
tcagactactatgtcacgaccggtgctcgatttagagagagtgtgttggggtttgggggtgtggtggtctccactcccgccttgacggggctgctatctgcctcgctggccatcactgggctccaggctgaggatgagggtgattactactgccagtcgtcgaagatgttcggcgagggactaagctgaccgtctaggtcagcccaaggctgccccctggtcactctgttccccaccctcctcacatagtagtctgagcgggctggcaaggcncatagnnnnnnnnnnnnnnnnnnnnnnnn

SEQ ID NO: 264409 - DNA, 444 bp, Homo sapiens
  misc_feature: GYAE6OF02GLXWH.24.53.E09.1.454.CMB.1.raw
  modified_base (161)..(161): a, c, t, g, unknown or other
  misc_feature (161)..(161): n is a, c, g, or t
  modified_base (425)..(425): a, c, t, g, unknown or other
  misc_feature (425)..(425): n is a, c, g, or t
  modified_base (431)..(444): a, c, t, g, unknown or other
  misc_feature (431)..(444): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactggctccaggctgaggatggagggtgattactactgccagtcgtcgaagatggttcggcggagggactaagctgaccgtctaggtcagcccaaggctcgcccctggtcactctcgttccccgccctcctcacatacgtagtctgagcgggctggcaagggcncatagnnnnnnnnnnnnnn

SEQ ID NO: 264410 - DNA, 438 bp, Homo sapiens
  misc_feature: GYAE6OF02GW4JD.24.53.E09.1.454.CMB.1.raw
  modified_base (161)..(161): a, c, t, g, unknown or other
  misc_feature (161)..(161): n is a, c, g, or t
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgagatgagggtgattactactgccagtcgtcgaagatgttcggcggagggactaaggctgaccgtcctaggtcagcccaaggctcgcccctggtcactctcgtccccacctcctcactatagtagtctgagcgggctggcaagggcncatagnnnnnnnnnn

SEQ ID NO: 264411 - DNA, 451 bp, Homo sapiens
  misc_feature: GYAE6OF02IFRNL.24.53.E09.1.454.CMB.1.raw
  modified_base (161)..(161): a, c, t, g, unknown or other
  misc_feature (161)..(161): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (438)..(451): a, c, t, g, unknown or other
  misc_feature (438)..(451): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttaccaaaaacngaccccccaaactcctcatttatcgtaacaacaatcggccctctggggtccctgaccgattctccgcctccaagtctggccacctcagcctcgctggccatccacgtgggctccaggctgaggatggagggtgattactactgccagtcgtcgaagatggttcgggcggagggactaagctgaccgtcctaggtcacgcccaaggctcgcccctggtcactctcgtccccaccctcctcactatagtagtcngaggcggntcggacaaggcgcatgnnnnnnnnnnnnnn

SEQ ID NO: 264412 - DNA, 436 bp, Homo sapiens
  misc_feature: GYAE6OF02GXNMW.24.53.E09.1.454.CMB.1.raw
  modified_base (162)..(162): a, c, t, g, unknown or other
  misc_feature (162)..(162): n is a, c, g, or t
  modified_base (418)..(418): a, c, t, g, unknown or other
  misc_feature (418)..(418): n is a, c, g, or t
  modified_base (424)..(436): a, c, t, g, unknown or other
  misc_feature (424)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgtcggcggaggactaagctgaccgtctaggtcagcccaaggctcgcccctggtcactctgttccccacctcctcacatagtagtctgacgcgggctggcaggcncatagnnnnnnnnnnnnn

SEQ ID NO: 264413 - DNA, 561 bp, Homo sapiens
  misc_feature: GYAE6OF02G8K72.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcaccgtggagtcgcatctagaatacttcagcagttcggggccagggccaccgtggtccaccgtcctcctcacgcctccaccgaacgggcccagttccggtccttcccccgtggccgccctcgccgtcccgaggacgccacccgtccgagacgcacgcgccgcccgtgggcctcgccgtcggtaccgaacggtacctaccgttccaacgtacgtacgtacgtctacggg

SEQ ID NO: 264414 - DNA, 435 bp, Homo sapiens
  misc_feature: GYAE6OF02HPSSS.24.53.E09.1.454.CMB.1.raw
  modified_base (162)..(162): a, c, t, g, unknown or other
  misc_feature (162)..(162): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (428)..(435): a, c, t, g, unknown or other
  misc_feature (428)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgcccagtcgtcgaagatgttcggcggagggactaagctgaccgtctaggtcagcccaaggctgcccctggtcactctcgttcccaccctccncacatagtcgtctgagcgggntgggcaaggcgnatagnnnnnnnn

SEQ ID NO: 264415 - DNA, 515 bp, Homo sapiens
  misc_feature: GYAE6OF02F2UOA.24.53.E09.1.454.CMB.1.raw
  modified_base (427)..(427): a, c, t, g, unknown or other
  misc_feature (427)..(427): n is a, c, g, or t
tcagactactatgtcacgaccggtgctcgatttagagagagtgtgttgggtttggggaggcttggtccagcctgggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttcagcattggggccagggcacctggtcaccgtctcctcagcctccaccaagggcccatcggtcttcccccnggccgccctgctcccaggacgccacctccgagacgcacagccggccctgggcctgcctgggcaaggctacttccacatagtagtctgg

SEQ ID NO: 264416 - DNA, 449 bp, Homo sapiens
  misc_feature: GYAE6OF02FGWSS.24.53.E09.1.454.CMB.1.raw
  modified_base (161)..(161): a, c, t, g, unknown or other
  misc_feature (161)..(161): n is a, c, g, or t
  modified_base (182)..(182): a, c, t, g, unknown or other
  misc_feature (182)..(182): n is a, c, g, or t
  modified_base (441)..(449): a, c, t, g, unknown or other
  misc_feature (441)..(449): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttancgtaacaacaatcggccctctggggtccctgaccgattcctccgcctccaagtctggcacctcagcctcgctggcccatcactggctccaggctgaggatggagggtgattactactgccagtcgtcgaagatgtcggcggaggactaagctgaccgtcctaggtcacgcccaagggcctcgccccctggtccactctcgttccccaccccttcctacactatagtagtctggagcgggctcggacaacggcgcatagnnnnnnnnn

SEQ ID NO: 264417 - DNA, 282 bp, Homo sapiens; identical to SEQ ID NO: 264326
  misc_feature: GYAE6OF02FO15N.24.53.E09.1.454.CMB.1.raw
  modified_base (281)..(282): a, c, t, g, unknown or other
  misc_feature (281)..(282): n is a, c, g, or t

SEQ ID NO: 264418 - DNA, 452 bp, Homo sapiens
  misc_feature: GYAE6OF02IBXTC.24.53.E09.1.454.CMB.1.raw
  modified_base (162)..(162): a, c, t, g, unknown or other
  misc_feature (162)..(162): n is a, c, g, or t
  modified_base (223)..(223): a, c, t, g, unknown or other
  misc_feature (223)..(223): n is a, c, g, or t
  modified_base (327)..(327): a, c, t, g, unknown or other
  misc_feature (327)..(327): n is a, c, g, or t
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
  modified_base (444)..(452): a, c, t, g, unknown or other
  misc_feature (444)..(452): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattcnccgcctccaagtctggccacctcagccctcgctggccatcactgggcctccaggctggaggatggagggtgattactactgcccagttcgcgaagatgttcggnggaggactaagctgaccgtctaggtcacgcccaaggcctcgccccctggtcactcctcgttccccaccctccncacctatagtacgtctggacgcgggctcggcaaggcncatacgnnnnnnnnn

SEQ ID NO: 264419 - DNA, 470 bp, Homo sapiens
  misc_feature: GYAE6OF02IPM1Z.24.53.E09.1.454.CMB.1.raw
  modified_base (166)..(166): a, c, t, g, unknown or other
  misc_feature (166)..(166): n is a, c, g, or t
  modified_base (422)..(422): a, c, t, g, unknown or other
  misc_feature (422)..(422): n is a, c, g, or t
  modified_base (439)..(470): a, c, t, g, unknown or other
  misc_feature (439)..(470): n is a, c, g, or t
tcagactactatgtcacgaccggtgctcgatttagagagagtgtgttggggtttgggggctgtttttggaagctgcttgtaccacgagggtcaccatctccctgcactgggagcaacatcggcgctaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctcaggctgaggatcggagggtgatttacactgccaggtcgtcggaagatgttcggcggaggactaagctagaaccgtctaggtcacgcccaaggctcgccccctggtcactctcgttccccaccctcctcacattagtatctgagcgggntggacaaggcgcatagnnnnnnnnnnnnnnnnnnnnnnnnnnnnnnnn

SEQ ID NO: 264420 - DNA, 432 bp, Homo sapiens
  misc_feature: GYAE6OF02HXXHP.24.53.E09.1.454.CMB.1.raw
  modified_base (427)..(432): a, c, t, g, unknown or other
  misc_feature (427)..(432): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggtgattacactgccagtcgtcgaagatgttcggcggagggactaagctgaccgtcctaggtcagcccaaggctcgccccctcggtccactctgttcccaccctcctcacatagtagtctgagcgggctggcaaggcgcatgnnnnnn

SEQ ID NO: 264421 - DNA, 281 bp, Homo sapiens; identical to SEQ ID NO: 263523
  misc_feature: GYAE6OF02IUQIX.24.53.E09.1.454.CMB.1.raw
  modified_base (281)..(281): a, c, t, g, unknown or other
  misc_feature (281)..(281): n is a, c, g, or t

SEQ ID NO: 264422 - DNA, 282 bp, Homo sapiens; identical to SEQ ID NO: 264326
  misc_feature: GYAE6OF02F8VGJ.24.53.E09.1.454.CMB.1.raw
  modified_base (281)..(282): a, c, t, g, unknown or other
  misc_feature (281)..(282): n is a, c, g, or t

SEQ ID NO: 264423 - DNA, 282 bp, Homo sapiens; identical to SEQ ID NO: 263549
  misc_feature: GYAE6OF02FI88L.24.53.E09.1.454.CMB.1.raw
  modified_base (281)..(282): a, c, t, g, unknown or other
  misc_feature (281)..(282): n is a, c, g, or t

SEQ ID NO: 264424 - DNA, 381 bp, Homo sapiens
  misc_feature: GYAE6OF02F0VH5.24.53.E09.1.454.CMB.1.raw
  modified_base (376)..(381): a, c, t, g, unknown or other
  misc_feature (376)..(381): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctcggtcactctgttccccaccctcctcacatagtagtctgagcgggctggcaaggcgcatagnnnnnn

SEQ ID NO: 264425 - DNA, 299 bp, Homo sapiens
  misc_feature: GYAE6OF02GXWA6.24.53.E09.1.454.CMB.1.raw
  modified_base (285)..(299): a, c, t, g, unknown or other
  misc_feature (285)..(299): n is a, c, g, or t
tcagactactatgtcacgaccggtgctcgatttagagagagtgtgttggggtttgggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagcccaaggctcgccccctggtcactctcgttccccaccctcctcactatagtagtctgagcgggctggcaaggcgcatagcnnnnnnnnnnnnnnn

SEQ ID NO: 264426 - DNA, 295 bp, Homo sapiens
  misc_feature: GYAE6OF02IVE12.24.53.E09.1.454.CMB.1.raw
  modified_base (284)..(295): a, c, t, g, unknown or other
  misc_feature (284)..(295): n is a, c, g, or t
tcagactactatgtcacgaccggtgctcgatttagagagagtgtgttgggtttggggggtgtggtggtctccactcccgccttgacggggctgctatctgcctagctggcccatcactgggctccgaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggctaaggcgcatagnnnnnnnnnnnn

SEQ ID NO: 264427 - DNA, 440 bp, Homo sapiens
  misc_feature: GYAE6OF02IHAXL.24.53.E09.1.454.CMB.1.raw
  modified_base (433)..(440): a, c, t, g, unknown or other
  misc_feature (433)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcattttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggcctgccccctggtcactctcgttcccaccctcctcacatagtagtctgagcgggctgggcaagggcgcatagnnnnnnnn

SEQ ID NO: 264428 - DNA, 285 bp, Homo sapiens
  misc_feature: GYAE6OF02JCIRQ.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttcccacctcctcacatagtagtctgagcgggctggcaaggcgcatagnnnnnn

SEQ ID NO: 264429 - DNA, 282 bp, Homo sapiens; identical to SEQ ID NO: 263490
  misc_feature: GYAE6OF02HL176.24.53.E09.1.454.CMB.1.raw
  modified_base (280)..(282): a, c, t, g, unknown or other
  misc_feature (280)..(282): n is a, c, g, or t

SEQ ID NO: 264430 - DNA, 434 bp, Homo sapiens
  misc_feature: GYAE6OF02F3M1J.24.53.E09.1.454.CMB.1.raw
  modified_base (420)..(420): a, c, t, g, unknown or other
  misc_feature (420)..(420): n is a, c, g, or t
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctggtcactctcgttcccgccctcctcacatacgtagtctgagcggctggcaaggcncatagnnnnnnnnn

SEQ ID NO: 264431 - DNA, 435 bp, Homo sapiens
  misc_feature: GYAE6OF02GKEUQ.24.53.E09.1.454.CMB.1.raw
  modified_base (162)..(162): a, c, t, g, unknown or other
  misc_feature (162)..(162): n is a, c, g, or t
  modified_base (426)..(435): a, c, t, g, unknown or other
  misc_feature (426)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctcgtcccaccctcctcacatagtagtctgagcgggctggcaaggcgcatgnnnnnnnnnn

SEQ ID NO: 264432 - DNA, 437 bp, Homo sapiens
  misc_feature: GYAE6OF02FU6A2.24.53.E09.1.454.CMB.1.raw
  modified_base (431)..(437): a, c, t, g, unknown or other
  misc_feature (431)..(437): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaattggccctctgggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtccactctcgttccccgccctcctcacatagtagtctgagcgggctggcaagggcgcatagnnnnnnn

SEQ ID NO: 264433 - DNA, 436 bp, Homo sapiens
  misc_feature: GYAE6OF02G6DA0.24.53.E09.1.454.CMB.1.raw
  modified_base (432)..(436): a, c, t, g, unknown or other
  misc_feature (432)..(436): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctcggtcactctcgttcccgcccttcctcacatagtagtctgagcgggctgggcaaggcgcatagnnnnn

SEQ ID NO: 264434 - DNA, 437 bp, Homo sapiens
  misc_feature: GYAE6OF02GGNGX.24.53.E09.1.454.CMB.1.raw
  modified_base (426)..(426): a, c, t, g, unknown or other
  misc_feature (426)..(426): n is a, c, g, or t
  modified_base (432)..(437): a, c, t, g, unknown or other
  misc_feature (432)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcncatagnnnnnn

SEQ ID NO: 264435 - DNA, 280 bp, Homo sapiens; identical to SEQ ID NO: 263488
  misc_feature: GYAE6OF02GY2IM.24.53.E09.1.454.CMB.1.raw
  modified_base (280)..(280): a, c, t, g, unknown or other
  misc_feature (280)..(280): n is a, c, g, or t

SEQ ID NO: 264436 - DNA, 538 bp, Homo sapiens
  misc_feature: GYAE6OF02FKEKL.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggcccagggcaccctggtcaccgtctccctcagcctccaccaacgggcccatcggtccttccccctgggccgtcccctgcctcccaggacgccaccctccgagacgccacgacgccggccctgggcctcgccctgggtccaaggacctacttccaccatacgtagtctagg

SEQ ID NO: 264437 - DNA, 283 bp, Homo sapiens
  misc_feature: GYAE6OF02INBCT.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttccccaccctcctcacatagtagtctgagcgggctggcaaggcgcatagnnn

SEQ ID NO: 264438 - DNA, 514 bp, Homo sapiens
  misc_feature: GYAE6OF02HAD7L.24.53.E09.1.454.CMB.1.raw
  modified_base (450)..(450): a, c, t, g, unknown or other
  misc_feature (450)..(450): n is a, c, g, or t
  modified_base (502)..(502): a, c, t, g, unknown or other
  misc_feature (502)..(502): n is a, c, g, or t
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttcagcattggggccagggcaccctgtcaccgtctcctcagcctccaccaacgggcccagtccggtccttcccctggccgccctgcctccaggcncacctcgagacgcacagccgcctgggcctgcctggtcaaggactacttccanatagtagtctgg

SEQ ID NO: 264439 - DNA, 287 bp, Homo sapiens
  misc_feature: GYAE6OF02HPTGG.24.53.E09.1.454.CMB.1.raw
  modified_base (282)..(287): a, c, t, g, unknown or other
  misc_feature (282)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagagtctgagcgggctggcaaggcgcatagnnnnnn

SEQ ID NO: 264440 - DNA, 285 bp, Homo sapiens
  misc_feature: GYAE6OF02G1AVF.24.53.E09.1.454.CMB.1.raw
  modified_base (282)..(285): a, c, t, g, unknown or other
  misc_feature (282)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttccccgccctcctcacatagtagtctgagcgggctggcaaggcgcatagnnnn

SEQ ID NO: 264441 - DNA, 441 bp, Homo sapiens
  misc_feature: GYAE6OF02HUMW2.24.53.E09.1.454.CMB.1.raw
  modified_base (426)..(426): a, c, t, g, unknown or other
  misc_feature (426)..(426): n is a, c, g, or t
  modified_base (432)..(441): a, c, t, g, unknown or other
  misc_feature (432)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccagctgaggatgagggtgattactactgccagtcgtcgaagatgttcggcggagggactaagctgaccgtctaggtcagcccaagctgccccctggtcactctcgttccccgccctccctcaccatacgtagtctgacgcgggctggcaaggcncatagnnnnnnnnnn

SEQ ID NO: 264442 - DNA, 442 bp, Homo sapiens
  misc_feature: GYAE6OF02IOG91.24.53.E09.1.454.CMB.1.raw
  modified_base (322)..(322): a, c, t, g, unknown or other
  misc_feature (322)..(322): n is a, c, g, or t
  modified_base (428)..(442): a, c, t, g, unknown or other
  misc_feature (428)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgagggtgattacactgccagtcgtcgaagatgttcggnggaggactaagctgaccgtctaggtcagcccaaggctgccccctggtcactctgttccccgccctccctcacatagtagtctgagcgggctggcaaggcgcatagnnnnnnnnnnnnnnn

SEQ ID NO: 264443 - DNA, 430 bp, Homo sapiens
  misc_feature: GYAE6OF02HGJC7.24.53.E09.1.454.CMB.1.raw
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
  modified_base (422)..(430): a, c, t, g, unknown or other
  misc_feature (422)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttaacgtaacaacaatcggccctctggggtccctgaccgattctccgcctccaagtctggcacctcagcctcgctggccatcactggctccaggctgaggatgaggttgattactactgccagtcgtcgaagatgttcggnggagggactaagctgaccgtctaggtcagcccaaggctcgcccctggtcactctgttcccgccctctcacatagtagtctgagcggctggcaaggcncagtgnnnnnnnnn

SEQ ID NO: 264444 - DNA, 284 bp, Homo sapiens
  misc_feature: GYAE6OF02HXOPS.24.53.E09.1.454.CMB.1.raw
  modified_base (281)..(284): a, c, t, g, unknown or other
  misc_feature (281)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccgccctcctcacatagtagtctgagcgggctggcaaggcgcatagnnnn

SEQ ID NO: 264445 - DNA, 278 bp, Homo sapiens
  misc_feature: GYAE6OF02H7UQY.24.53.E09.1.454.CMB.1.raw
tcagactactatgtcacgaccggtgctcgatttagagagagtgtgttgggtttgggggtgtggtggtctccactcccgccttgactgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatag

SEQ ID NO: 264446 - DNA, 511 bp, Homo sapiens
  misc_feature: GYAE6OF02HYTDX.24.53.E09.1.454.CMB.1.raw
  modified_base (174)..(174): a, c, t, g, unknown or other
  misc_feature (174)..(174): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
  modified_base (476)..(499): a, c, t, g, unknown or other
  misc_feature (476)..(499): n is a, c, g, or t
  modified_base (501)..(511): a, c, t, g, unknown or other
  misc_feature (501)..(511): n is a, c, g, or t
tcagactactatgtcacgaccggtgctcgatttagagagagtgtggttgggtttgggggctgtttttggaaggtctgcttgtacctagagggtcaccatctcctgcactgggagcaacatcggcggcgagggttttggatgtccacgtgggtaccaagcagcttcccaaaaacngcccccaaactcctcatttactcgtaaacaacaatcggccctntggggtccctgaccgattcnccgcctccaagtctggcacctcaggcctcgctaggccatcactgggctccgaggctagaaggatggagggtgactttaacgtaacgtcgcccaagtccgtccgaagagtcgttcggcggagggactaaagctagaccgtctaggtcagcccagcncgcccctggtcactctgttcccaccctctacactatagtagtctaggagcgggnttagggcctaagggcctactaagttacggnnnnnnnnnnnnnnnnnnnnnnnncnnnnnnnnnnn

SEQ ID NO: 264447 - DNA, 456 bp, Homo sapiens
  misc_feature: GYAE6OF02IMW4R.24.53.E09.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (391)..(391): a, c, t, g, unknown or other
  misc_feature (391)..(391): n is a, c, g, or t
  modified_base (427)..(456): a, c, t, g, unknown or other
  misc_feature (427)..(456): n is a, c, g, or t
tcagactactatgtcacgaccggtgctcgatttagagagagtgtgttgggtttgggggctgttttggaagctgcttgtaccagagggtcaccatctcctgcactgggagcaaacatcggcgcaggttttgatgtccactggtacaagcagcttccaaaaacngccccccaaaatcctcatttancgtaaacaacaatcggccctctggggtccctgacccgattctccgcctccaagtctggcacctcagcctcgctggccatcactgggctcaggctgagatgaggtgattactactgccagtcgtcgaagatgtcggcggagggactaagctgacccgtctaggtccagcccaaggctgcccccgtggtcactctgttcccacctcctnacatagtatctgagcgggctggcaaggcgacatagnnnnnnnnnnnnnnnnnnnnnnnnnnnnnn

SEQ ID NO: 264448 - DNA, 381 bp, Homo sapiens
  misc_feature: GYAE6OF02HYE0O.24.53.E09.1.454.CMB.1.raw
  modified_base (375)..(381): a, c, t, g, unknown or other
  misc_feature (375)..(381): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttcccaccctctcacatagtagtctgagcgggctggcaaggcgacatagnnnnnnn

SEQ ID NO: 264449 - DNA, 289 bp, Homo sapiens
  misc_feature: GYAE6OF02INHRQ.24.53.E09.1.454.CMB.1.raw
  modified_base (279)..(289): a, c, t, g, unknown or other
  misc_feature (279)..(289): n is a, c, g, or t
tcagactactatgtcacgaccggtgctcgatttagagagagtgtgttgggttgggggtgtggtggtctccactcccgccttgacgggctgctatctgcctcgctggccatcactgggctccaggctgaggatgagggtgattactactgccagtcgtcgaagatgttcgcggagggactaagctgaccgtcctaggtcagcccaaggcctgccccctcggtcactctgttccccacccctcctcacatagtagctgagcgggctggcaaggcgcatagnnnnnnnnnnn

SEQ ID NO: 264450 - DNA, 445 bp, Homo sapiens
  misc_feature: GYAE6OF02HDVKE.24.53.E09.1.454.CMB.1.raw
  modified_base (161)..(161): a, c, t, g, unknown or other
  misc_feature (161)..(161): n is a, c, g, or t
  modified_base (288)..(288): a, c, t, g, unknown or other
  misc_feature (288)..(288): n is a, c, g, or t
  modified_base (431)..(445): a, c, t, g, unknown or other
  misc_feature (431)..(445): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtnattacactgccagtcgtcgaagatggttcggcggagggactaaggctgaccgtctaggcagcccaaggctcgcccctggtcactctcgttccccacctcctcacatagtagtctgacgcgggctgggacaaggcgacagtagnnnnnnnnnnnnnnn

SEQ ID NO: 264451 - DNA, 451 bp, Homo sapiens
  misc_feature: GYAE6OF02GFR5U.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (433)..(451): a, c, t, g, unknown or other
  misc_feature (433)..(451): n is a, c, g, or t
tcagactactatgtcacgaccggtgctcgatttagagagagtgtgttgggtttgggggctgttttggaagctgcttgtaccagagggtcaccatcctcctgcactgggagcaacatcggcgcaggttttgatgtccactggtacaagcagcttccaaaaacngcccccaaatcctcatttancgtaacaacaatcggccctctggggtccctgaccgattcctccgcctccgagtctggcacctcagcctcgctggcccatccactggctccaggcctgaggactgacgggtgattactactgcccagtcgtcgaagatgttcggcggagggactaagctgacccgtctaggtcagcccaaggctgccccctggtcactctgttccccgccctcctcacatacgtagctgagcgggctggcaaggcgcatagnnnnnnnnnnnnnnnnnnn

SEQ ID NO: 264452 - DNA, 283 bp, Homo sapiens
  misc_feature: GYAE6OF02IPQX4.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacaagtagtctgagcgggctggcaaggcgcatagnnnnn

SEQ ID NO: 264453 - DNA, 430 bp, Homo sapiens
  misc_feature: GYAE6OF02IUNIW.24.53.E09.1.454.CMB.1.raw
  modified_base (419)..(419): a, c, t, g, unknown or other
  misc_feature (419)..(419): n is a, c, g, or t
  modified_base (424)..(430): a, c, t, g, unknown or other
  misc_feature (424)..(430): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaagctgcccctggtcactctgttcccaccctcctcacatagtagtctgagcgggctgggcaaggcgnatagnnnnnnn

SEQ ID NO: 264454 - DNA, 289 bp, Homo sapiens
  misc_feature: GYAE6OF02IWUJB.24.53.E09.1.454.CMB.1.raw
  modified_base (279)..(279): a, c, t, g, unknown or other
  misc_feature (279)..(279): n is a, c, g, or t
  modified_base (285)..(289): a, c, t, g, unknown or other
  misc_feature (285)..(289): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgaattactactgccagtcgtcgaagatgttcggcggagggactaagctgaccgtcctaggtcagcccaaggctgccccctggtcactctcgttccccgccctcctcacataagtatctggagcgggctggcaagggcncatagnnnnn

SEQ ID NO: 264455 - DNA, 459 bp, Homo sapiens
  misc_feature: GYAE6OF02H8A1J.24.53.E09.1.454.CMB.1.raw
  modified_base (428)..(428): a, c, t, g, unknown or other
  misc_feature (428)..(428): n is a, c, g, or t
  modified_base (434)..(459): a, c, t, g, unknown or other
  misc_feature (434)..(459): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaaacagccccccaaaactccctcatttatcgtaacaacaatcggccctctggggtccctgaccgattctccgctccaagtctggcacctcagcctcgctggccatcactgggctccaggctgaggatgagggtgattactactgcccagtcgtcgaagctgttcggcggagggactaagctgaccgtctaggtcagcccaaggctcgccccctggtcactctcgttccccaccctcctcacatacgtacgtctgagcgggctggcaaggcncatagnnnnnnnnnnnnnnnnnnnnnnnnnn

SEQ ID NO: 264456 - DNA, 437 bp, Homo sapiens
  misc_feature: GYAE6OF02HR1OZ.24.53.E09.1.454.CMB.1.raw
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (426)..(437): a, c, t, g, unknown or other
  misc_feature (426)..(437): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatggaggtgattactactgccagtcgtcgaagatgttcggcggagggactaagctgaccgtcctaggtcagcccaaggcctcgcccctcggtcactctcgttcccacctcctcacagtntcngagcggctggacaacggcacatagnnnnnnnnnnnn

SEQ ID NO: 264457 - DNA, 566 bp, Homo sapiens
  misc_feature: GYAE6OF02G1N9C.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccgagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagccaccgtggagtcgcatctagaatcttccagctagttcggggccagggccacccgtgtccaccgtctcctcacgcctccaccgacggcccagttccggtcccttccccgtggccgccctcgcctcccgaggcgccacccgtccgagacgcaccgcgccggcccgtgggcctcggcccgttgggtaccgaacggtaccttaccttacccaacgtacttacggtacgtcgtagg

SEQ ID NO: 264458 - DNA, 459 bp, Homo sapiens
  misc_feature: GYAE6OF02G97KI.24.53.E09.1.454.CMB.1.raw
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (447)..(459): a, c, t, g, unknown or other
  misc_feature (447)..(459): n is a, c, g, or t
tcagactactatgtcacgaccggtgctcgatttagagagagtgtgttgagtttgggggctgtttttggaagctgcttgtaccagagggtcaccatctcctgcactggggagcaacatcggcgcaggttttgatgtccactggtacaagcagcttccaaaaacagcccccaaactcctcatttatcgtaacaacaatcggccctctggggtccctgaccgattcctccgcctccaagtctggcacctcagcctcgctggccatcactgggctccaggctgaggntggagggtnattactactgccagtcgtacgaagtntggttcggcggagggactaaggctgacccgtctaggtcacgcccaaggcctcgccccctcggtcactctcgttccccacctcctcacatacgtagtctggacggcgggtctggcaacggcgctagtagnnnnnnnnnnnnn

SEQ ID NO: 264459 - DNA, 435 bp, Homo sapiens
  misc_feature: GYAE6OF02GAPSU.24.53.E09.1.454.CMB.1.raw
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctgttccccaccctcctcacatagtagtctgagcgggctggcaaggcncatagnnnnnnnn

SEQ ID NO: 264460 - DNA, 283 bp, Homo sapiens; identical to SEQ ID NO: 263465
  misc_feature: GYAE6OF02HS6NK.24.53.E09.1.454.CMB.1.raw
  modified_base (279)..(283): a, c, t, g, unknown or other
  misc_feature (279)..(283): n is a, c, g, or t

SEQ ID NO: 264461 - DNA, 280 bp, Homo sapiens; identical to SEQ ID NO: 263488
  misc_feature: GYAE6OF02GDENL.24.53.E09.1.454.CMB.1.raw
  modified_base (280)..(280): a, c, t, g, unknown or other
  misc_feature (280)..(280): n is a, c, g, or t

SEQ ID NO: 264462 - DNA, 486 bp, Homo sapiens
  misc_feature: GYAE6OF02GRK3E.24.53.E09.1.454.CMB.1.raw
  modified_base (325)..(325): a, c, t, g, unknown or other
  misc_feature (325)..(325): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
  modified_base (455)..(460): a, c, t, g, unknown or other
  misc_feature (455)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(469): a, c, t, g, unknown or other
  misc_feature (468)..(469): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (480)..(483): a, c, t, g, unknown or other
  misc_feature (480)..(483): n is a, c, g, or t
  modified_base (485)..(485): a, c, t, g, unknown or other
  misc_feature (485)..(485): n is a, c, g, or t
tcagactactatgtcacgaccggtgctcgatttagagagagtgtgttgagtttgggggctgtttttggaagctcgcttgtaccagacgggtcaccatctcctgcactgggagcaacatcggcgcaggttttgatgtccactggtacaagcagcttccaaaaacagcccccaaatcctcatttatcgtaacaacaatcggccctctggggtccctagaccgattcctccgcctccaagttctggcacctcagcctcgctggccatcactgggctcaggctgaggatgaggtgattactactgcctagtcgtcggaagatgttcggnggagggactaagctgaccgtcgtagtcagccaaggctgccccctggtcacgttctcgttcccgcccttcctcacatgtagtctgagcggtctggcaaggcgcagtagncgncgtnagctcgagctatntnnnnnntntntntnntnctntntntnnnngnc

SEQ ID NO: 264463 - DNA, 444 bp, Homo sapiens
  misc_feature: GYAE6OF02IH4F7.24.53.E09.1.454.CMB.1.raw
  modified_base (436)..(444): a, c, t, g, unknown or other
  misc_feature (436)..(444): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaaacagccccccaaactcctcattttatcgtaacaacaatccggccctctggggtccctgaccgattcctccgcctccaagtctggccacctcagcctcgctggccatcactgggctccaggctgaggatggagggtgattactactgcccagttcgtcgaagatggttcggcggagggactaagctgaccgtctaggcagcccaggctcgcccctggtcactctcgttccccaccctcctcacatagtagtctgagcgggctggcaaggcgacatagnnnnnnnnn

SEQ ID NO: 264464 - DNA, 433 bp, Homo sapiens
  misc_feature: GYAE6OF02F773D.24.53.E09.1.454.CMB.1.raw
  modified_base (430)..(433): a, c, t, g, unknown or other
  misc_feature (430)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnn

SEQ ID NO: 264465 - DNA, 286 bp, Homo sapiens
  misc_feature: GYAE6OF02GM601.24.53.E09.1.454.CMB.1.raw
  modified_base (281)..(286): a, c, t, g, unknown or other
  misc_feature (281)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcggggctggcaaggcgcatagnnnnnn

SEQ ID NO: 264466 - DNA, 286 bp, Homo sapiens
  misc_feature: GYAE6OF02HM69W.24.53.E09.1.454.CMB.1.raw
  modified_base (278)..(286): a, c, t, g, unknown or other
  misc_feature (278)..(286): n is a, c, g, or t
tcagactactatgtcacgaccggtgctcgatttagagagagtgtgttgggtttgggggtgtggtggtctccactcccgccttgaccgggctgctatctgcctcgctggccatcactgggctccaggctgaggatgagggtgattactactgcccagtcgtcgaagatgttcggcggagggactaagctgaccgtctaggtcagcccaaggctgccccctggtcactctgttcccgcctcctcacatatagtctgagcgggctggcaaggcgacatagnnnnnnnnn

SEQ ID NO: 264467 - DNA, 448 bp, Homo sapiens
  misc_feature: GYAE6OF02HOBPC.24.53.E09.1.454.CMB.1.raw
  modified_base (162)..(162): a, c, t, g, unknown or other
  misc_feature (162)..(162): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (431)..(448): a, c, t, g, unknown or other
  misc_feature (431)..(448): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactggctcaggctgagntgaggtnattacactgccagtcgtcgaagntgtcggcggagggactaagctgaccgtctaggtcacgcccaaggcctcgccccctggtcactctcgttccccaccctcctcactatagtacgtctgacgcgggctgggacaaggcgcatagnnnnnnnnnnnnnnnnnn

SEQ ID NO: 264468 - DNA, 342 bp, Homo sapiens
  misc_feature: GYAE6OF02HCUR2.24.53.E09.1.454.CMB.1.raw
  modified_base (289)..(342): a, c, t, g, unknown or other
  misc_feature (289)..(342): n is a, c, g, or t
tcagactactatgtcacgaccggtgctcgatttagagagagtgtgttggggtttgggggtagtggtcggtctccactcccgcccttgacggggctgctatctgcctcgctggccatcactgggctcctaggctgaggatgagggtgattactactgcccagtcgtcgaagatgttcggcggagggactaagctgaccgtcctaggtcagcccgaaggctgccccctggtcactctgttcccaccctcctcacatagtagtctgagcggcgtggacgaaggcgcagtagnnnnnnnnnnnnnnnnnnnnnnnnnnnnnnnnnnnnnnnnnnnnnnnnnnnnnn

SEQ ID NO: 264469 - DNA, 531 bp, Homo sapiens
  misc_feature: GYAE6OF02JTQQS.24.53.E09.1.454.CMB.1.raw
  modified_base (270)..(270): a, c, t, g, unknown or other
  misc_feature (270)..(270): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacgggctggagtgggtggccaatataaggcacgatggacgtagcatgtactatgtggactctgtgaagggccgattcaccatctccagagacaacgccagaactcactgtatcnggaaatgaccagcctgagatcgaggacacggctatgtattactgtgcgaccatatcagcacctggatcgcatctgaatcttccagcaagttcggggccaggggccacccgtaggtcaaccgtcctccctcacgcctcccaccgaacggcccatcccggtccttccccgtcgccgccctgcctccgagacgccacctacgngacnccaacgcgccgccnggcctgcctggcaaggtctaccttcaacgctagtacgtctagg

SEQ ID NO: 264470 - DNA, 288 bp, Homo sapiens
  misc_feature: GYAE6OF02JYQHM.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcaatagnnnnnnnnn

SEQ ID NO: 264471 - DNA, 279 bp, Homo sapiens; identical to SEQ ID NO: 264223
  misc_feature: GYAE6OF02HK8FL.24.53.E09.1.454.CMB.1.raw

SEQ ID NO: 264472 - DNA, 282 bp, Homo sapiens
  misc_feature: GYAE6OF02G1KIY.24.53.E09.1.454.CMB.1.raw
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctcaactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnn

SEQ ID NO: 264473 - DNA, 582 bp, Homo sapiens
  misc_feature: GYAE6OF02IW03A.24.53.E09.1.454.CMB.1.raw
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (579)..(580): a, c, t, g, unknown or other
  misc_feature (579)..(580): n is a, c, g, or t
tcagactactatgtcacgaccggtgctcgatttagagagagtgtgttggggtttgggggactgtttttcggaagcgtgcttcgtaccagagggtcaccatctcctgcactggagcaacatcggcgctaggttttgatgtccactggtacaagcagcttccaaaaacngcccccaaatcctcattttatcgtaacaacaatcggcctntgggtccctgaccgattcnccgcctccgaagtctggccaccgtcgacgccttcgctggccatcactggctccgaggctgacggatggagggtnaattacgtactgcctaggttccgtcgaagatcggtcgggcggagggtactaagctgaaccgtcgtaggtcacgacccgaaggtccgtcgacccccgtggtacctacgttcctccgttacccccaccgtccctacgacctaagttaaccgttacgtctacggacggtccgggtacgtcgggaacgaacgggaccgtacgtaagttacgntacanactnacgnacgtncncgagcngntntatgtncagacgtcncncgcgngcgtacgcgcgcgtcgtcnncg

SEQ ID NO: 264474 - DNA, 443 bp, Homo sapiens
  misc_feature: GYAE6OF02I5YUO.24.53.E09.1.454.CMB.1.raw
  modified_base (434)..(443): a, c, t, g, unknown or other
  misc_feature (434)..(443): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgtcggcggagggactaagctgaccgtctaggtcagcccaaggctcgcccctggtcactctcgttccccaccctcctacactatagtactcgtgacgcgggctggacaacgggcgcatagnnnnnnnnnn

SEQ ID NO: 264475 - DNA, 441 bp, Homo sapiens
  misc_feature: GYAE6OF02HJFOI.24.53.E09.1.454.CMB.1.raw
  modified_base (162)..(162): a, c, t, g, unknown or other
  misc_feature (162)..(162): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (427)..(441): a, c, t, g, unknown or other
  misc_feature (427)..(441): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattcctccgcctccaagtctggcacctcagcctcgctggccatcactgggctccaggctgaggatgagggtgattactactgccagtcgtcgaagntgtcggnggagggactaagctgaccgtctaggtcagccaaggctcgccccctggtcactctcgtcccaccctctcacatagtatctgacgcgggntcgggcaaggcgcatagnnnnnnnnnnnnnnn

SEQ ID NO: 264476 - DNA, 285 bp, Homo sapiens
  misc_feature: GYAE6OF02IO7I4.24.53.E09.1.454.CMB.1.raw
  modified_base (281)..(285): a, c, t, g, unknown or other
  misc_feature (281)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcacttctgttccccaccctcctcaacatagtagtctgagcgggctggcaaggcgcatagnnnnn

SEQ ID NO: 264477 - DNA, 281 bp, Homo sapiens; identical to SEQ ID NO: 264311
  misc_feature: GYAE6OF02F7HR0.24.53.E09.1.454.CMB.1.raw
  modified_base (280)..(281): a, c, t, g, unknown or other
  misc_feature (280)..(281): n is a, c, g, or t

SEQ ID NO: 264478 - DNA, 440 bp, Homo sapiens
  misc_feature: GYAE6OF02FQHFV.24.53.E09.1.454.CMB.1.raw
  modified_base (425)..(425): a, c, t, g, unknown or other
  misc_feature (425)..(425): n is a, c, g, or t
  modified_base (431)..(440): a, c, t, g, unknown or other
  misc_feature (431)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatggagggtgattactactgccagtcgtcgaagatggttcggcggagggactaagctgaccgtctaggtcagcccaaggctcgcccctgtcactctcgttccccaccctcctcacatagtagtctgagcgggctggcaaggcncatagnnnnnnnnnn

SEQ ID NO: 264479 - DNA, 563 bp, Homo sapiens
  misc_feature: GYAE6OF02IZ8ZD.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggatcgcatctgaatacttccagcagttcggggccagggccacccgtggtccaccggtctccctcacgccctccaccgaacgggcccacgttccggtcccttcccccgtggcccgtccctcgcctcccgaggacgccacccgtccgagcgccacgacgccggccctgggcctcggcccttgggaccaacggtaccttaccttcccactacgtagttacgtcgtacgg

SEQ ID NO: 264480 - DNA, 508 bp, Homo sapiens
  misc_feature: GYAE6OF02HN51S.24.53.E09.1.454.CMB.1.raw
  modified_base (494)..(508): a, c, t, g, unknown or other
  misc_feature (494)..(508): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggtttgatgtccactggtacaagcagcttccaaaaacagcccccaaactcctcatttatcgtaacaacaatcggccctctggggtccctgaccgattcctccgcctccaagtctggccaccctcacgcctcgcgtcggccatccacgtcgggcctccgaggctggaggagtggagggtgtaattactacgtcgcctaggtcgtacgaagtagttgggttcgggacgggagggtaactaagcgtacggacccgttccgtaggtaccacgacccgaaggcctccggcccccgtgtcctactcttccgtccccgccctcctacactagtacgtacgtctggacggcgggcgtcgggacgaacgggcacgagtgnnnnnnnnnnnnnnn

SEQ ID NO: 264481 - DNA, 438 bp, Homo sapiens
  misc_feature: GYAE6OF02IS9ZP.24.53.E09.1.454.CMB.1.raw
  modified_base (289)..(289): a, c, t, g, unknown or other
  misc_feature (289)..(289): n is a, c, g, or t
  modified_base (427)..(438): a, c, t, g, unknown or other
  misc_feature (427)..(438): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgagatggagggtnattactactgccagtcgtcgaagatgttcggcggaggactagctgaccgtctaggtcagcccaaggctcgcccctgcactctcgtcccgccctcctcactagtagtacgtctgaggcgggctggcaaggccgcatagnnnnnnnnnnnn

SEQ ID NO: 264482 - DNA, 450 bp, Homo sapiens
  misc_feature: GYAE6OF02FZI6S.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (424)..(424): a, c, t, g, unknown or other
  misc_feature (424)..(424): n is a, c, g, or t
  modified_base (430)..(450): a, c, t, g, unknown or other
  misc_feature (430)..(450): n is a, c, g, or t
tcagactactatgtcacgaccggtgctcgatttagagagagtgtggttgggtttgggggctgttttggaagctgcttgtaccagagggtcaccatctcctgcactgggagcaacatcggcgcaggttttgatgtccactggtacaagcagcttccaaaaacngcccccaaatcctcatttancgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttccccaccctcctcacatagtacgtctgagcgggctggcaaggcgnatagcnnnnnnnnnnnnnnnnnnnnn

SEQ ID NO: 264483 - DNA, 449 bp, Homo sapiens
  misc_feature: GYAE6OF02GEXDO.24.53.E09.1.454.CMB.1.raw
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (427)..(427): a, c, t, g, unknown or other
  misc_feature (427)..(427): n is a, c, g, or t
  modified_base (434)..(449): a, c, t, g, unknown or other
  misc_feature (434)..(449): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactccctcatttatcgtaacaacaatcggccctctggggtccctgaccgattctccgcctccaagtctggcacctcagcctcgctggccatcactgggctccaggctgaggatgagggtnattactactgcccagtcgtcgaagatggttcggnggagggactaagctgaccgtctaggtcagcccaaggctcgcccctggtcactctcgttccccgccctcctcacatagtacgtctgagcgggctggcaagggcncagtagnnnnnnnnnnnnnnnn

SEQ ID NO: 264484 - DNA, 281 bp, Homo sapiens; identical to SEQ ID NO: 264311
  misc_feature: GYAE6OF02FPB52.24.53.E09.1.454.CMB.1.raw
  modified_base (280)..(281): a, c, t, g, unknown or other
  misc_feature (280)..(281): n is a, c, g, or t

SEQ ID NO: 264485 - DNA, 432 bp, Homo sapiens
  misc_feature: GYAE6OF02FKLUL.24.53.E09.1.454.CMB.1.raw
  modified_base (430)..(432): a, c, t, g, unknown or other
  misc_feature (430)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagnnn

SEQ ID NO: 264486 - DNA, 282 bp, Homo sapiens
  misc_feature: GYAE6OF02F77ZF.24.53.E09.1.454.CMB.1.raw
  modified_base (274)..(274): a, c, t, g, unknown or other
  misc_feature (274)..(274): n is a, c, g, or t
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcncatagnnn

SEQ ID NO: 264487 - DNA, 287 bp, Homo sapiens
  misc_feature: GYAE6OF02G95G5.24.53.E09.1.454.CMB.1.raw
  modified_base (279)..(287): a, c, t, g, unknown or other
  misc_feature (279)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnnnnnnn

SEQ ID NO: 264488 - DNA, 435 bp, Homo sapiens
  misc_feature: GYAE6OF02GE4SQ.24.53.E09.1.454.CMB.1.raw
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgttcccaccctcctcacatagtagtctgagcgggctggcaaggcncatagnnnnnnnn

SEQ ID NO: 264489 - DNA, 323 bp, Homo sapiens
  misc_feature: GYAE6OF02I58BY.24.53.E09.1.454.CMB.1.raw
  modified_base (291)..(292): a, c, t, g, unknown or other
  misc_feature (291)..(292): n is a, c, g, or t
  modified_base (294)..(323): a, c, t, g, unknown or other
  misc_feature (294)..(323): n is a, c, g, or t
tcagactactatgtcacgaccggtgctcgatttagagagagtgtgttgggtttgggggtgtggtggtctccactcccgccttgacggggctgctatcctgcctcgctggccatcacctgggctccaggctgacggatgagggtgattactaactgccagtcgtcgaagatgttccggcggacgggactaagctgaccgtcctaggtcagcccaaggcctcgccccctcggtcactcgtcgttcccgccctcctcacatagtagtctgagcgggcctggcaaggcgcatagnngnnnnnnnnnnnnnnnnnnnnnnnnnnnnnn

SEQ ID NO: 264490 - DNA, 433 bp, Homo sapiens
  misc_feature: GYAE6OF02HOFPC.24.53.E09.1.454.CMB.1.raw
  modified_base (418)..(418): a, c, t, g, unknown or other
  misc_feature (418)..(418): n is a, c, g, or t
  modified_base (424)..(433): a, c, t, g, unknown or other
  misc_feature (424)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgagatgagggtgattactactgccagtcgtcgaagatgttcggcggagggactaagctgaccgtctaggtcagccaaggctgcccctggcactctcgttcccaccctcctcacatagtagtctgagcgggctgggcaaggcncatagnnnnnnnnnn

SEQ ID NO: 264491 - DNA, 279 bp, Homo sapiens; identical to SEQ ID NO: 264223
  misc_feature: GYAE6OF02F8529.24.53.E09.1.454.CMB.1.raw

SEQ ID NO: 264492 - DNA, 443 bp, Homo sapiens
  misc_feature: GYAE6OF02GVRSN.24.53.E09.1.454.CMB.1.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (433)..(443): a, c, t, g, unknown or other
  misc_feature (433)..(443): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagcccccaaactcctcatttatcgtaacaacaatcggccctctggggtccctgaccgattctccgcctccaagtctggcacctcagcctcgctggccatcactggctccaggctgaggatgagggtnattactactgccagtcgtcgaagntggttcggcggagggactaagctgaccgtctaggtcagcccaaggctcgcccctggtcactctcgttccccgccctcctcacatagtacgtctggacgcgggctgggcaaggcgcatagnnnnnnnnnnn

SEQ ID NO: 264493 - DNA, 525 bp, Homo sapiens
  misc_feature: GYAE6OF02IPHGE.24.53.E09.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (469)..(469): a, c, t, g, unknown or other
  misc_feature (469)..(469): n is a, c, g, or t
  modified_base (472)..(475): a, c, t, g, unknown or other
  misc_feature (472)..(475): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (485)..(486): a, c, t, g, unknown or other
  misc_feature (485)..(486): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (496)..(497): a, c, t, g, unknown or other
  misc_feature (496)..(497): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (515)..(516): a, c, t, g, unknown or other
  misc_feature (515)..(516): n is a, c, g, or t
  modified_base (518)..(519): a, c, t, g, unknown or other
  misc_feature (518)..(519): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
tcagactactatgtcacgaccggtgctcgatttagagagagtgtgttggggtttgggggctgttttggaagctgcttgtaccagagggttcaccatctcctgcactggagcaacatcggcgcaggttttgatgttccgactggtacaagtcagcttccaaaaactagcccccaaatccctacatttatcgtaanaacaattcggcctntgggtccctgaccgattcnccgctcgaagtctggcactcagcctcgctggccatcactggctccaggctgagatgaggtnattacgtactcgacccaggtcgtacgaaggtattggttcgggcggagggactaagtcttagaccgttccgtaggtcacggtacccaaaggtcctacgtcccccgtaggtcaccttcgtcggttccccgcctccgtaccaacgtataacgtactctgacgcggactgacaaggcactatagntgnnnngntacgnagnngantnanagnngagngngagcagnantcnncnngngtnc

SEQ ID NO: 264494 - DNA, 281 bp, Homo sapiens; identical to SEQ ID NO: 263461
  misc_feature: GYAE6OF02HNGPE.24.53.E09.1.454.CMB.1.raw
  modified_base (280)..(281): a, c, t, g, unknown or other
  misc_feature (280)..(281): n is a, c, g, or t

SEQ ID NO: 264495 - DNA, 285 bp, Homo sapiens
  misc_feature: GYAE6OF02H42MJ.24.53.E09.1.454.CMB.1.raw
  modified_base (273)..(273): a, c, t, g, unknown or other
  misc_feature (273)..(273): n is a, c, g, or t
  modified_base (279)..(285): a, c, t, g, unknown or other
  misc_feature (279)..(285): n is a, c, g, or t
tcagactactatgtcacgaccggtgctcgatttagagagagtgtgttgggtttgggggtgtggtggtctccactccgccttgacgggctgctatctgcctcgctggccatcactggctccaggctgaggatgagggtgattactactgccagtcgtcgaagatgttcggcggagggactaagctgaccgtcctaggtcagcccaaggctcgccccctggtcactctcgttccccgccctcctcacatacgtagtctgagcggctggcaaggcncatagnnnnnnn

SEQ ID NO: 264496 - DNA, 557 bp, Homo sapiens
  misc_feature: GYAE6OF02FXXHY.24.53.E09.1.454.CMB.1.raw
  modified_base (443)..(443): a, c, t, g, unknown or other
  misc_feature (443)..(443): n is a, c, g, or t
  modified_base (478)..(478): a, c, t, g, unknown or other
  misc_feature (478)..(478): n is a, c, g, or t
tcagactactatgtcacgaccggtgctcgatttagagagagtgtggttgggtttgggaggcttggtccagcctgggggtccctgagactctcctgtgcagcctctggattcccctttagtgacttttggatgacctgggtccgccaggctccagggacggggctggagtgggtggccaatataaggctacgatggacgtagcatgtactatgtggactctgtgaagggccgattcgaccatcctccgagagacaacgcccagaacctcactgtatctggaaatgaccagcctgagagtcgaggacacggctatgtattactgtgcgacatatcagcacctggagtcgcatctgaatacttccagcagttggggcctagggcaccctggtccaccgtctcctcacgccctccaccaagggccccagttccggtaccttccccgnggccgccctgccttccaggcgccacctccgagacnccacgacgccggccctgggccttggcccgttggtaccgaaggtccttaccgttccaacgtagtacggtacgtctacggg

SEQ ID NO: 264497 - DNA, 281 bp, Homo sapiens
  misc_feature: GYAE6OF02GSGYC.24.53.E09.1.454.CMB.1.raw
  modified_base (279)..(281): a, c, t, g, unknown or other
  misc_feature (279)..(281): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagagtctgagcgggctggcaaggcgcatagnnn

SEQ ID NO: 264498 - DNA, 585 bp, Homo sapiens
  misc_feature: GYAE6OF02F594S.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttcagcagttggggccagggccacccgtggtccacccgtctcctcacgcctcccaccgaacgggccccagttccggtccttcccccgtcggcccgtccccgtcgccttcccgaggcgccacccgtccggaagacgccacgacggccggcccgtggggcctcggcccgttgggtaccaaacgggtaccttaccgtttacccaacgtaacgtaacggttacgttcgtacggg

SEQ ID NO: 264499 - DNA, 434 bp, Homo sapiens
  misc_feature: GYAE6OF02JG4AD.24.53.E09.1.454.CMB.1.raw
  modified_base (426)..(434): a, c, t, g, unknown or other
  misc_feature (426)..(434): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgatctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctggtcactctcgttcccaccctcctcacatagtagtctgacgcggctggcaaggcgcatagnnnnnnnnn

SEQ ID NO: 264500 - DNA, 448 bp, Homo sapiens
  misc_feature: GYAE6OF02IZH4O.24.53.E09.1.454.CMB.1.raw
  modified_base (161)..(161): a, c, t, g, unknown or other
  misc_feature (161)..(161): n is a, c, g, or t
  modified_base (222)..(222): a, c, t, g, unknown or other
  misc_feature (222)..(222): n is a, c, g, or t
  modified_base (431)..(448): a, c, t, g, unknown or other
  misc_feature (431)..(448): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattcnccgcctccaagtctggcacctcagcctcgctggccatcactgggctccaggctgaggatggagggtgattactactgccagtcgtcgaagatggttcgggcggagggactaagctgaccgtcctaggtcacgcccaaggctcgcccctggcactctcgtccccgccctctcacatagtagtctgaggcgggctggcaaggcgcagtagnnnnnnnnnnnnnnnnnn

SEQ ID NO: 264501 - DNA, 280 bp, Homo sapiens; identical to SEQ ID NO: 263948
  misc_feature: GYAE6OF02HFEXZ.24.53.E09.1.454.CMB.1.raw
  modified_base (278)..(280): a, c, t, g, unknown or other
  misc_feature (278)..(280): n is a, c, g, or t

SEQ ID NO: 264502 - DNA, 448 bp, Homo sapiens
  misc_feature: GYAE6OF02JHUN4.24.53.E09.1.454.CMB.1.raw
  modified_base (162)..(162): a, c, t, g, unknown or other
  misc_feature (162)..(162): n is a, c, g, or t
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
  modified_base (430)..(448): a, c, t, g, unknown or other
  misc_feature (430)..(448): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattcctccgcctccaagtctggcacctcagcctcgctggccatcactggctccaggctgagatgagggtnattactactgccagtcgtcgaagatgttcggcggagggactagctgaccgtctaggtcagcccaaggcctcgccccctggtccactctcgttccccaccctcctcacatagtacgtctgagcggctggcaggccncatagnnnnnnnnnnnnnnnnnnn

SEQ ID NO: 264503 - DNA, 281 bp, Homo sapiens; identical to SEQ ID NO: 263485
  misc_feature: GYAE6OF02HEIVP.24.53.E09.1.454.CMB.1.raw
  modified_base (280)..(281): a, c, t, g, unknown or other
  misc_feature (280)..(281): n is a, c, g, or t

SEQ ID NO: 264504 - DNA, 284 bp, Homo sapiens; identical to SEQ ID NO: 264444
  misc_feature: GYAE6OF02JBRZX.24.53.E09.1.454.CMB.1.raw
  modified_base (281)..(284): a, c, t, g, unknown or other
  misc_feature (281)..(284): n is a, c, g, or t

SEQ ID NO: 264505 - DNA, 519 bp, Homo sapiens
  misc_feature: GYAE6OF02JR2VT.24.53.E09.1.454.CMB.1.raw
  modified_base (164)..(164): a, c, t, g, unknown or other
  misc_feature (164)..(164): n is a, c, g, or t
  modified_base (232)..(232): a, c, t, g, unknown or other
  misc_feature (232)..(232): n is a, c, g, or t
  modified_base (297)..(297): a, c, t, g, unknown or other
  misc_feature (297)..(297): n is a, c, g, or t
  modified_base (487)..(487): a, c, t, g, unknown or other
  misc_feature (487)..(487): n is a, c, g, or t
  modified_base (489)..(492): a, c, t, g, unknown or other
  misc_feature (489)..(492): n is a, c, g, or t
  modified_base (494)..(519): a, c, t, g, unknown or other
  misc_feature (494)..(519): n is a, c, g, or t
tcagactactatgtcacgaccggtgctcgatttagagagagtgtgttgggtttgggggcgtgttttggtaagtctgcttgtaccagagggtcaccatctcctgcactgggagcaacatcggcgcaggttttgatgtccactggtacaagcagcttccaaaaacngccccccaaaatccctccatttactcgtaaacaacaatcggaccctctggggtcccctgaccgattcnccgcctccaagtctggccacctcagcctcgctggccatcactggctccaggctgagatgagggtnattactactgcccaggtccgtcgaagatggttcggcgggaagggtataacggctacggacccgttcctaaggtccagccccgaaggcttcggcccccctgggtaccacgtcctcgttcccccgcccttccgtccactacgtacgtacgtcctggacgccgggactcgggacgaaggccgaccagtacgcngnnnncnnnnnnnnnnnnnnnnnnnnnnnnnn

SEQ ID NO: 264506 - DNA, 555 bp, Homo sapiens
  misc_feature: GYAE6OF02IOZD1.24.53.E09.1.454.CMB.1.raw
  modified_base (315)..(315): a, c, t, g, unknown or other
  misc_feature (315)..(315): n is a, c, g, or t
  modified_base (464)..(464): a, c, t, g, unknown or other
  misc_feature (464)..(464): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaaggccgattcaccatctccagagacaacgcccagaactcactgtatctggaaatgaccagcctgagagtcgaggacacggctatgtattacngtgcgaccatatcagcacctggagtcgcatctagaacttacttccagctagttcggggaccagggccacccgtggtccacccgtctcctcacgcctccaccgaacggcccattcgtccttccccgtggccgtccctgcctccgacggcnccaccgtccgagacgcacgacgccggcccgtcggcctcggcctggtaccgaacggtaccttacttccacgtactacggttacgtcgtacgg

SEQ ID NO: 264507 - DNA, 282 bp, Homo sapiens; identical to SEQ ID NO: 264326
  misc_feature: GYAE6OF02HYZY9.24.53.E09.1.454.CMB.1.raw
  modified_base (281)..(282): a, c, t, g, unknown or other
  misc_feature (281)..(282): n is a, c, g, or t

SEQ ID NO: 264508 - DNA, 291 bp, Homo sapiens
  misc_feature: GYAE6OF02H2E4O.24.53.E09.1.454.CMB.1.raw
  modified_base (278)..(291): a, c, t, g, unknown or other
  misc_feature (278)..(291): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctgccccctggtcactctcgttccccgccctcctcacatagagtctgagcgggctggcaaggcgcatagnnnnnnnnnnnnnn

SEQ ID NO: 264509 - DNA, 564 bp, Homo sapiens
  misc_feature: GYAE6OF02IJY07.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccagggacggggctggagtgggtggccaaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctagaatacttccagcagttggggccagggccacccgtggtaacccgtctcctcacgcctccaccgaacggccctacgtccggttccttcccccgtggcccgtccctcggcctccgacgacgtccaccgtccgagacgccacacgccgcccgtggctcggcctggtaccaaggacccttacgttcccaactagttacgtacgttcctaggacggg

SEQ ID NO: 264510 - DNA, 283 bp, Homo sapiens
  misc_feature: GYAE6OF02FOM2P.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnn

SEQ ID NO: 264511 - DNA, 303 bp, Homo sapiens
  misc_feature: GYAE6OF02JV9UM.24.53.E09.1.454.CMB.1.raw
  modified_base (139)..(139): a, c, t, g, unknown or other
  misc_feature (139)..(139): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (284)..(303): a, c, t, g, unknown or other
  misc_feature (284)..(303): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtnattactactgccagtcgtcgaagatgttcggcgagggactaagctgaccgtctaggtcagcccaaggcctggccccctggtccactcctcgttccccaccctcctnaactatagtagtctggaggcggctggcaaggcgcanagnnnnnnnnnnnnnnnnnnnn

SEQ ID NO: 264512 - DNA, 280 bp, Homo sapiens; identical to SEQ ID NO: 263547
  misc_feature: GYAE6OF02GTYVV.24.53.E09.1.454.CMB.1.raw
  modified_base (279)..(280): a, c, t, g, unknown or other
  misc_feature (279)..(280): n is a, c, g, or t

SEQ ID NO: 264513 - DNA, 529 bp, Homo sapiens
  misc_feature: GYAE6OF02H10JY.24.53.E09.1.454.CMB.1.raw
  modified_base (162)..(162): a, c, t, g, unknown or other
  misc_feature (162)..(162): n is a, c, g, or t
  modified_base (498)..(529): a, c, t, g, unknown or other
  misc_feature (498)..(529): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtcccctgaccgattctccgcctccaagtctggcacctcagcctcgctggccatcactgggctccaggctgaggatgagggtgattactactgcccagtcgtcgaagatggttcggcggagggactaaggctcgaccgtcctaggtccacggccccaagggcctcggtccccccgtcgggtccaccttccgtccgttcccccaacccttccctacactaacgtacggttacgtaccttggaacgggccggggtcgtcgggaccggaacgggtccgacgaacgttaaggcnnnnnnnnnnnnnnnnnnnnnnnnnnnnnnnn

SEQ ID NO: 264514 - DNA, 510 bp, Homo sapiens
  misc_feature: GYAE6OF02JHVQ8.24.53.E09.1.454.CMB.1.raw
  modified_base (161)..(161): a, c, t, g, unknown or other
  misc_feature (161)..(161): n is a, c, g, or t
  modified_base (290)..(290): a, c, t, g, unknown or other
  misc_feature (290)..(290): n is a, c, g, or t
  modified_base (475)..(475): a, c, t, g, unknown or other
  misc_feature (475)..(475): n is a, c, g, or t
  modified_base (477)..(481): a, c, t, g, unknown or other
  misc_feature (477)..(481): n is a, c, g, or t
  modified_base (483)..(510): a, c, t, g, unknown or other
  misc_feature (483)..(510): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaaatcctcatttatcgtaacaacaatcggccctctggggtccctgaccgattctccgcctccaagtctggcacctcagcctcgctggccatcacgtggctccgaggctgaggactgagggtnattactacgtgcctaggtcgtacgaagagtggtttccggcggaagggactaaacgctggacccgtctagggtcaagcccaaggctcgcccccgtggtcacgttctcgttccccgcccttccgtcactactagtaccgtctgtacggcgggcctgggtaccaaagggtcccgactaagttagcgancnnnnngnnnnnnnnnnnnnnnnnnnnnnnnnnnn

SEQ ID NO: 264515 - DNA, 441 bp, Homo sapiens
  misc_feature: GYAE6OF02HSWR2.24.53.E09.1.454.CMB.1.raw
  modified_base (162)..(162): a, c, t, g, unknown or other
  misc_feature (162)..(162): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (428)..(441): a, c, t, g, unknown or other
  misc_feature (428)..(441): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacttcagcctcgctggccatcactgggctccaggctgaggatgagggtgattactactgccagtcgtacgagatggtcggcggagggactaagctgaccgtctaggtcagcccaaggctcgcccctggtcactctcgttcccaccctcncacatagtacgtcngacgcgggctggcaggccgcatagnnnnnnnnnnnnnn

SEQ ID NO: 264516 - DNA, 283 bp, Homo sapiens
  misc_feature: GYAE6OF02H9KK5.24.53.E09.1.454.CMB.1.raw
  modified_base (280)..(283): a, c, t, g, unknown or other
  misc_feature (280)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgtttcggcggagggactaagctgaccgtcctaggtcagcccaaggctgccccctcggtcactctgttccccaccctctcacatagtatctgagcgggctggcaaggcgcatagnnnn

SEQ ID NO: 264517 - DNA, 449 bp, Homo sapiens
  misc_feature: GYAE6OF02H74XD.24.53.E09.1.454.CMB.1.raw
  modified_base (163)..(163): a, c, t, g, unknown or other
  misc_feature (163)..(163): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (440)..(449): a, c, t, g, unknown or other
  misc_feature (440)..(449): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngacccccaaactcctcatttatcgtaacaacaatcggccctctggggtccctgaccgattcctccgcctccaagtctggcacctcagcctcgctggccatcactgggctccaggctgagatgaggtnattactactgccagtcgtcgaaagatgttccggnggaagggactaagctagaccgtcaaggtcagcccaaggctcgccccctggtcactctcgttccccaccctcctcactatagtacgtctgagcgggctggcctaaggcgacaatagnnnnnnnnnn

SEQ ID NO: 264518 - DNA, 439 bp, Homo sapiens
  misc_feature: GYAE6OF02FPX4U.24.53.E09.1.454.CMB.1.raw
  modified_base (428)..(439): a, c, t, g, unknown or other
  misc_feature (428)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctgttcccaccctcctcacatagtagtctgagcgggctggcaaggcgcatagnnnnnnnnnnnn

SEQ ID NO: 264519 - DNA, 454 bp, Homo sapiens
  misc_feature: GYAE6OF02H077L.24.53.E09.1.454.CMB.1.raw
  modified_base (162)..(162): a, c, t, g, unknown or other
  misc_feature (162)..(162): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (403)..(403): a, c, t, g, unknown or other
  misc_feature (403)..(403): n is a, c, g, or t
  modified_base (441)..(454): a, c, t, g, unknown or other
  misc_feature (441)..(454): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcattttatcgtaacaacaatcggccctctggggtccctgaccgattctccgcctccaagtctggccacctcagcctcgctggccatcactgggcctccaggctgaggatggagggtnattactactgccagtcgtcgaagntggttcggcggagggactaagctgaccgtcgtaggtcacgcccaaggcctcgcccctggtcactctcgttcccaccctcctcacntcgtagtctgacggcgggctgggacaaggcgcagtagnnnnnnnnnnnnnn

SEQ ID NO: 264520 - DNA, 288 bp, Homo sapiens
  misc_feature: GYAE6OF02ISE1I.24.53.E09.1.454.CMB.1.raw
  modified_base (281)..(288): a, c, t, g, unknown or other
  misc_feature (281)..(288): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcggggctggcaaggcgcatagnnnnnnnn

SEQ ID NO: 264521 - DNA, 281 bp, Homo sapiens; identical to SEQ ID NO: 264311
  misc_feature: GYAE6OF02FHVCM.24.53.E09.1.454.CMB.1.raw
  modified_base (280)..(281): a, c, t, g, unknown or other
  misc_feature (280)..(281): n is a, c, g, or t

SEQ ID NO: 264522 - DNA, 446 bp, Homo sapiens
  misc_feature: GYAE6OF02I6K76.24.53.E09.1.454.CMB.1.raw
  modified_base (162)..(162): a, c, t, g, unknown or other
  misc_feature (162)..(162): n is a, c, g, or t
  modified_base (289)..(289): a, c, t, g, unknown or other
  misc_feature (289)..(289): n is a, c, g, or t
  modified_base (432)..(446): a, c, t, g, unknown or other
  misc_feature (432)..(446): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtnattactactgccagtccgtcgaagatgttcggcggagggactaagctgaccgtctaggtcagcccaaggctcgcccctggtcactctcgttccccaccctcctcactatagtacgtctgacgcgggctggcaggcgcagtagnnnnnnnnnnnnnnn

SEQ ID NO: 264523 - DNA, 509 bp, Homo sapiens
  misc_feature: GYAE6OF02H0YMF.24.53.E09.1.454.CMB.1.raw
  modified_base (489)..(509): a, c, t, g, unknown or other
  misc_feature (489)..(509): n is a, c, g, or t
tcagactactatgtcacgaccggtgctcgatttagagagagtgtgttgggtttgggggctgtttttggaagctgcttgtaccagagggtcaccatctccctgcactgggagcaacatcggcgctaggttttgatgtccactggtacaagcagcttaccaaaaacacgaccccccaaaactccctcatttatcgtaacaacaatcggccctcgtgggtccctgaccgattctccgcctccaagtctggcaccctcacgcctcgctcggccatcacgtcgggcctccaggctggaggatggagggtgtaatttacctacgtgccctaggtccgtacgaagagttcggttcgggcgggagggactaaggctcggacctccgtagtcacgcccaaggcctcgcccctcggtctactcgtccgttccccaccctcctaccactacgtagtacgtcgtggacggccgggtcgtcggacgacggtcgctagtacgnnnnnnnnnnnnnnnnnnnnn

SEQ ID NO: 264524 - DNA, 281 bp, Homo sapiens; identical to SEQ ID NO: 263535
  misc_feature: GYAE6OF02GI5S3.24.53.E09.1.454.CMB.1.raw
  modified_base (279)..(281): a, c, t, g, unknown or other
  misc_feature (279)..(281): n is a, c, g, or t

SEQ ID NO: 264525 - DNA, 458 bp, Homo sapiens
  misc_feature: GYAE6OF02IBJUF.24.53.E09.1.454.CMB.1.raw
  modified_base (162)..(162): a, c, t, g, unknown or other
  misc_feature (162)..(162): n is a, c, g, or t
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
  modified_base (439)..(458): a, c, t, g, unknown or other
  misc_feature (439)..(458): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaaacngcccccaaactcctcatttatcgtaacaacaatcggccctctggggtccctgaccgattctccgcctccaagtctggcacctcagcctcgctggccatcactgggctccaggctgaggatgagggtnattactactgcccagtcgtacgaagnttggtcggcggagggactaagctgaccgtctaggtcagcccaaggctcgcccctggtcactctcgttccccacctcctcactatagtcgtctgacggcgggctgggactaacggcgacagtagnnnnnnnnnnnnnnnnnnnn

SEQ ID NO: 264526 - DNA, 289 bp, Homo sapiens
  misc_feature: GYAE6OF02I145H.24.53.E09.1.454.CMB.1.raw
  modified_base (284)..(289): a, c, t, g, unknown or other
  misc_feature (284)..(289): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcacctctcgttccccgcccctcctcacatagtagtctgagcggctggcaaggcgcatagnnnnnn

SEQ ID NO: 264527 - DNA, 440 bp, Homo sapiens
  misc_feature: GYAE6OF02F5M8O.24.53.E09.1.454.CMB.1.raw
  modified_base (162)..(162): a, c, t, g, unknown or other
  misc_feature (162)..(162): n is a, c, g, or t
  modified_base (290)..(290): a, c, t, g, unknown or other
  misc_feature (290)..(290): n is a, c, g, or t
  modified_base (430)..(440): a, c, t, g, unknown or other
  misc_feature (430)..(440): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatgttcggcggagggactaagctgaccgtcctaggtcagcccaaggctgccccctggtcactctgttccccaccctcctcacatacgtagtctgagcgggctggcaaggcgcatagnnnnnnnnnnn

SEQ ID NO: 264528 - DNA, 436 bp, Homo sapiens
  misc_feature: GYAE6OF02GUTJJ.24.53.E09.1.454.CMB.1.raw
  modified_base (428)..(436): a, c, t, g, unknown or other
  misc_feature (428)..(436): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgccccctggtcactctgttccccgccctcctcacatagtacgtctgacgcgggctgggcaaggcgcatagnnnnnnnnn

SEQ ID NO: 264529 - DNA, 282 bp, Homo sapiens
  misc_feature: GYAE6OF02G1TVV.24.53.E09.1.454.CMB.1.raw
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnn

SEQ ID NO: 264530 - DNA, 448 bp, Homo sapiens
  misc_feature: GYAE6OF02FQCUH.24.53.E09.1.454.CMB.1.raw
  modified_base (161)..(161): a, c, t, g, unknown or other
  misc_feature (161)..(161): n is a, c, g, or t
  modified_base (434)..(448): a, c, t, g, unknown or other
  misc_feature (434)..(448): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttccccgccctcctcactatagtagtctgacgcgggctgggcaagggcgcagtagnnnnnnnnnnnnnnn

SEQ ID NO: 264531 - DNA, 448 bp, Homo sapiens
  misc_feature: GYAE6OF02I3RE3.24.53.E09.1.454.CMB.1.raw
  modified_base (162)..(162): a, c, t, g, unknown or other
  misc_feature (162)..(162): n is a, c, g, or t
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (432)..(448): a, c, t, g, unknown or other
  misc_feature (432)..(448): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngcccccaaatcctcatttatcgtaacaacaatcggccctgtggggtccctgaccgattcctccgcctccaagtctggccacctcagcctcgctcggccatccacgtgggctccaggctgagatgaggtgattactactgccagtcgtcgaagntgttcgggcggagggactaagctgacccgtctaggtcagcccaaggcctcgcccctggtcactcgtcgtcccaccctcncacatagtagtcngagcgggctggcaggcgcagtagcnnnnnnnnnnnnnnnnn

SEQ ID NO: 264532 - DNA, 553 bp, Homo sapiens
  misc_feature: GYAE6OF02FH2VF.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggtcaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattcggggccagggccaccctggtcacccgtctcctcacgcctccaccgaacgggcccagtccgtcccttcccctggccgccctcgcctccgacggacgccaccgtcccgagcgacacgacgccggcccgtgggccgtcggccctcggtccaacggaccttacttcccaactagtacgtacgtcgtacgg

SEQ ID NO: 264533 - DNA, 294 bp, Homo sapiens
  misc_feature: GYAE6OF02HY48M.24.53.E09.1.454.CMB.1.raw
  modified_base (278)..(278): a, c, t, g, unknown or other
  misc_feature (278)..(278): n is a, c, g, or t
  modified_base (284)..(294): a, c, t, g, unknown or other
  misc_feature (284)..(294): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtagtctgagcgggctggcaaggcncatagnnnnnnnnnnn

SEQ ID NO: 264534 - DNA, 559 bp, Homo sapiens
  misc_feature: GYAE6OF02F7Q5I.24.53.E09.1.454.CMB.1.raw
  modified_base (462)..(462): a, c, t, g, unknown or other
  misc_feature (462)..(462): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagactactatgtcacgaccggtgctcgatttagagagagtgtgttgggtttgggggaggcttggtccagcctggggggtccctgagactcgtcctggtgcagcctctggattcccctttagtgacttttggatgacctgggtcccgccaggcctccagggacggggctgggagtgggtggccaatataaggcacggatgggacgtagcatgtactatgtggactctggtgaagggccgattcgaccatctccagagacaacgcccagaactcactgtatctggaaatgaccagcctgagagtcgaggacacggctatgtattactgtgcgaccatatcagcacctggagtcgcatctgaaatacttccagcagtttgggggccaggggccacccgtggtcaccgtctccctcacgccctccaaccgaacgggcccagttccggtccttcccccgtggccnccccgtgcctccgaggcnccacctccgagacncacacgccgcccgtgggctcggcctggtacaacggtacttacctccaacagtacgtagtctacgg

SEQ ID NO: 264535 - DNA, 432 bp, Homo sapiens
  misc_feature: GYAE6OF02FT63H.24.53.E09.1.454.CMB.1.raw
  modified_base (426)..(432): a, c, t, g, unknown or other
  misc_feature (426)..(432): n is a, c, g, or t
tcagactactatgtcacgaccggtgctcgatttagagagagtgtgttgagtttgggggctgtttttggaggctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgcccctggtcactctcgttcccgccctcctcacatagtagtctgagcgggctggcaggcgcatagnnnnnnn

SEQ ID NO: 264536 - DNA, 285 bp, Homo sapiens
  misc_feature: GYAE6OF02GQC6S.24.53.E09.1.454.CMB.1.raw
  modified_base (284)..(285): a, c, t, g, unknown or other
  misc_feature (284)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctgggcaaggcgcatagnn

SEQ ID NO: 264537 - DNA, 291 bp, Homo sapiens
  misc_feature: GYAE6OF02I5JE7.24.53.E09.1.454.CMB.1.raw
  modified_base (286)..(291): a, c, t, g, unknown or other
  misc_feature (286)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttcccgcccctcctcacatacgtagtctgagcgggctggcaaggcgcagtagnnnnnn

SEQ ID NO: 264538 - DNA, 391 bp, Homo sapiens
  misc_feature: GYAE6OF02GAN8L.24.53.E09.1.454.CMB.1.raw
  modified_base (382)..(391): a, c, t, g, unknown or other
  misc_feature (382)..(391): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgacccgtcctaggtccagcccaaggctgccccctcggtcactcctgttccccaccctcctcacatagtagtctgagcggggctgggcaaggcgcatagnnnnnnnnnn

SEQ ID NO: 264539 - DNA, 289 bp, Homo sapiens
  misc_feature: GYAE6OF02IK5JR.24.53.E09.1.454.CMB.1.raw
  modified_base (280)..(289): a, c, t, g, unknown or other
  misc_feature (280)..(289): n is a, c, g, or t
tcagactactatgtcacgaccggtgctcgatttagagagagtgtgttggggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctcggtcactctcgttcccacctctcacatagtagtctgagcgggctggcaaggcgacatagnnnnnnnnnn

SEQ ID NO: 264540 - DNA, 435 bp, Homo sapiens
  misc_feature: GYAE6OF02FN58F.24.53.E09.1.454.CMB.1.raw
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (426)..(435): a, c, t, g, unknown or other
  misc_feature (426)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaatcctcatttatcgtaacaacaatcggccctctggggtccctgaccgattctccgcctccaagtctggcacctcagcctcgctggccatcactgggctccaggttgaggatgagggtgattactactgccagtcgtcgaagatgttcggcggagggactaagctgaccgtcctagtcacgccaaggctcgccccctggtcactctcgttcccaccctcctcacatagtagtctgacgcggntgcaaggcnatagnnnnnnnnnn

SEQ ID NO: 264541 - DNA, 474 bp, Homo sapiens
  misc_feature: GYAE6OF02IKZ59.24.53.E09.1.454.CMB.1.raw
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
  modified_base (439)..(440): a, c, t, g, unknown or other
  misc_feature (439)..(440): n is a, c, g, or t
  modified_base (442)..(474): a, c, t, g, unknown or other
  misc_feature (442)..(474): n is a, c, g, or t
tcagactactatgtcacgaccggtgctcgatttagagagagtgtgttggggtttgggggctgtttttggaagctgcttgtaccagagggttcaccatctcctgcactgggagcaacatcggcgcaggttttgatgtccactggtacaagtcagcttccaaaaacagcccccaaatccctcattttatcgtaacaacaatcggccctctggggtccctgaccgattctccgcctccaagtctggcacctcagccctcgctggccatcactgggctccaggctgaggatgagggtnattacactgccagtcgtcgaagatgtcggnggagggactaagctgaccgtctaggcagcccaaggctcgcccctggtcactctcgttcccncctccctcacatacgtagtctgngcgggcgtcggcgaacggacgacactagtanncnnnnnnnnnnnnnnnnnnnnnnnnnnnnnnnnn

SEQ ID NO: 264542 - DNA, 432 bp, Homo sapiens
  misc_feature: GYAE6OF02HD3TW.24.53.E09.1.454.CMB.1.raw
  modified_base (162)..(162): a, c, t, g, unknown or other
  misc_feature (162)..(162): n is a, c, g, or t
  modified_base (422)..(422): a, c, t, g, unknown or other
  misc_feature (422)..(422): n is a, c, g, or t
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgttccccaccctcctcacatagtagtctgagcgggctggcaggcncatgnnnnnn

SEQ ID NO: 264543 - DNA, 439 bp, Homo sapiens
  misc_feature: GYAE6OF02JBVKA.24.53.E09.1.454.CMB.1.raw
  modified_base (162)..(162): a, c, t, g, unknown or other
  misc_feature (162)..(162): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (427)..(439): a, c, t, g, unknown or other
  misc_feature (427)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctagaccgtctaggtcagcccaaggctcgcccctggtcactctgtcccaccctcncacatagtactcngacgcgggctggcaggcncntagnnnnnnnnnnnnn

SEQ ID NO: 264544 - DNA, 280 bp, Homo sapiens; identical to SEQ ID NO: 263573
  misc_feature: GYAE6OF02FTSM7.24.53.E09.1.454.CMB.1.raw
  modified_base (280)..(280): a, c, t, g, unknown or other
  misc_feature (280)..(280): n is a, c, g, or t

SEQ ID NO: 264545 - DNA, 446 bp, Homo sapiens
  misc_feature: GYAE6OF02G11CP.24.53.E09.1.454.CMB.1.raw
  modified_base (162)..(162): a, c, t, g, unknown or other
  misc_feature (162)..(162): n is a, c, g, or t
  modified_base (429)..(446): a, c, t, g, unknown or other
  misc_feature (429)..(446): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtcctaggtcagcccaaggctcgcccctggtcactctcgttcccaccctcctcacatagtacgtctgagcgggctggcaggcgcatagnnnnnnnnnnnnnnnnnn

SEQ ID NO: 264546 - DNA, 442 bp, Homo sapiens
  misc_feature: GYAE6OF02HZ3XZ.24.53.E09.1.454.CMB.1.raw
  modified_base (163)..(163): a, c, t, g, unknown or other
  misc_feature (163)..(163): n is a, c, g, or t
  modified_base (393)..(393): a, c, t, g, unknown or other
  misc_feature (393)..(393): n is a, c, g, or t
  modified_base (430)..(442): a, c, t, g, unknown or other
  misc_feature (430)..(442): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaaactcctcatttatcgtaaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtcctaggtcagcccaaggctgcccctggtcactctgttccccaccctccncacatagtagtctgagcgggctggcaaggcgcatagnnnnnnnnnnnnn

SEQ ID NO: 264547 - DNA, 282 bp, Homo sapiens
  misc_feature: GYAE6OF02FVTDJ.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnn

SEQ ID NO: 264548 - DNA, 382 bp, Homo sapiens
  misc_feature: GYAE6OF02FWOZY.24.53.E09.1.454.CMB.1.raw
  modified_base (237)..(237): a, c, t, g, unknown or other
  misc_feature (237)..(237): n is a, c, g, or t
  modified_base (370)..(370): a, c, t, g, unknown or other
  misc_feature (370)..(370): n is a, c, g, or t
  modified_base (376)..(382): a, c, t, g, unknown or other
  misc_feature (376)..(382): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatgttcggcggagggactaagctgaccgtcctaggtcagcccaaggctgccccctggtcactctgttccccaccctcctcacatagtagtctgagcgggctggcaaggcncatagnnnnnnn

SEQ ID NO: 264549 - DNA, 286 bp, Homo sapiens
  misc_feature: GYAE6OF02IJH0D.24.53.E09.1.454.CMB.1.raw
  modified_base (279)..(286): a, c, t, g, unknown or other
  misc_feature (279)..(286): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgaggtgattactactgccagtcgtcgaagatgttcggcggagggactaagctgaccgtcctaggtcagcccaaggctgccccctggtcacgtctcgttcccgccctcctcacatagtagtctgagcgggctggcaaggcgcatagnnnnnnnn

SEQ ID NO: 264550 - DNA, 281 bp, Homo sapiens; identical to SEQ ID NO: 263575
  misc_feature: GYAE6OF02FRRUR.24.53.E09.1.454.CMB.1.raw
  modified_base (280)..(281): a, c, t, g, unknown or other
  misc_feature (280)..(281): n is a, c, g, or t

SEQ ID NO: 264551 - DNA, 446 bp, Homo sapiens
  misc_feature: GYAE6OF02JEDGL.24.53.E09.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (408)..(409): a, c, t, g, unknown or other
  misc_feature (408)..(409): n is a, c, g, or t
  modified_base (411)..(446): a, c, t, g, unknown or other
  misc_feature (411)..(446): n is a, c, g, or t
tcagactactatgtcacgaccggtgctcgatttagagagagtgtgttgggtttgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagccctgctggccatcactgggctccaggctgaggntggagggtnattacactgccagtcgtcgaagatggttcggcggaggactaagctcggacccgtcctaggtccaggcccaaggctcgccccctggtcacgttcctcgttccccgccctcctacacagtagtacgtcctggacgtccggggactcggggacaagggccgctaagtagctnncnnnnnnnnnnnnnnnnnnnnnnnnnnnnnnnnnnnn

SEQ ID NO: 264552 - DNA, 438 bp, Homo sapiens
  misc_feature: GYAE6OF02F9NQY.24.53.E09.1.454.CMB.1.raw
  modified_base (424)..(438): a, c, t, g, unknown or other
  misc_feature (424)..(438): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaatcctcatttatcgtaacaacaatcggccctctggggtccctgaccgattctccgcctccaagtctggcacctcagcctcgctggccatcactgggctccagctgaggatgagggtgattactactgccagtcgtcgaagatgttcggcggagggactaagctgaccgtctaggtcagcccaaggctgccccctggtcactctgttccccgccctcctcacatagtagtctgagcgggctggcaaggcgcatgnnnnnnnnnnnnnnn

SEQ ID NO: 264553 - DNA, 456 bp, Homo sapiens
  misc_feature: GYAE6OF02ICUVM.24.53.E09.1.454.CMB.1.raw
  modified_base (374)..(374): a, c, t, g, unknown or other
  misc_feature (374)..(374): n is a, c, g, or t
  modified_base (445)..(456): a, c, t, g, unknown or other
  misc_feature (445)..(456): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcagggttttgatgtccactggtacaagcagcttccaaaaacaagcccccaaacctacctcatttatcgtaacaacaatcggcctctggggtccctgaccgattctccgcctccaagtctggcacctcagcctcgctggccatcactgggctccaggctgaggatgagggtgattactactgccagtgtcgaagatgttcggcgggaggactaagctcgacgtcctaggtcagcccaaggctcgcccctcggtnactctatccccgaccctcctcaacatagtacgtctacgagcgggcgtcggacgaaacggcggacaataagnnnnnnnnnnnn

SEQ ID NO: 264554 - DNA, 439 bp, Homo sapiens
  misc_feature: GYAE6OF02IOR5M.24.53.E09.1.454.CMB.1.raw
  modified_base (164)..(164): a, c, t, g, unknown or other
  misc_feature (164)..(164): n is a, c, g, or t
  modified_base (290)..(290): a, c, t, g, unknown or other
  misc_feature (290)..(290): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (429)..(439): a, c, t, g, unknown or other
  misc_feature (429)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggtttttgatgtccactggtacaagcagcttccaaaaaacngcccccaaatcctcatttatcgtaacaacaatcggccctctggggtccctgacccgattctccgcctccaagtctggcacctcagcctcgctggccatcactgggctccaggctgagatgagggtnattacactgccagtcgtcgaagatgttcggcggagggactaagctgaccgtctaggtcagcccaaggcctcgccccctggtcactctcgttcccacctccncactatagtagtctgacgcgggntggcagggcncatgnnnnnnnnnnn

SEQ ID NO: 264555 - DNA, 283 bp, Homo sapiens
  misc_feature: GYAE6OF02IS1ZN.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagnn

SEQ ID NO: 264556 - DNA, 464 bp, Homo sapiens
  misc_feature: GYAE6OF02GW251.24.53.E09.1.454.CMB.1.raw
  modified_base (163)..(163): a, c, t, g, unknown or other
  misc_feature (163)..(163): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (449)..(464): a, c, t, g, unknown or other
  misc_feature (449)..(464): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaactcctcatttatcgtaacaacaatcggccctctggggtccctgaccgattctccgcctccaagtctggcacctcagcctcgctggccatcacgtgggctccaggctgaggatgagggtnattactactgccagtcgcgaagntgttcggcggaggactaagctgaccgtcctaggtcacgcccaaggcctcgcccccgtggtccactcctcgttccccaccctcctcactatagtagtctggacgccggggctgggacgtaacggccgacaagtagnnnnnnnnnnnnnnnn

SEQ ID NO: 264557 - DNA, 280 bp, Homo sapiens
  misc_feature: GYAE6OF02HTGD7.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaaagatgttcggcggagggactaagctgaccgtcctaggtcagcccaaggctgccccctggtcactctcgttcccaccctcctcacatagtagtctgagcgggctggcaaggcgcatag

SEQ ID NO: 264558 - DNA, 319 bp, Homo sapiens
  misc_feature: GYAE6OF02HL7BA.24.53.E09.1.454.CMB.1.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (294)..(319): a, c, t, g, unknown or other
  misc_feature (294)..(319): n is a, c, g, or t
tcagactactatgtcacgaccggtgctcgatttagagagagtgtgttgggtttggggggtgtggtggtctccactcccgccttgacgtgggctgctatctgcctcgctggccatcacgtgggctccaggctggaggatgagggtgattactactgccagtcgtacgaagatgttcggcggagggtactaagctcgaccgtcgtaggtcagccaaggctcgcccctggtcactctcgttccccgcctcctcacatagtagtctggacgcgggntaggaccaaggcgctatagngnnnnnnnnnnnnnnnnnnnnnnnnnn

SEQ ID NO: 264559 - DNA, 434 bp, Homo sapiens
  misc_feature: GYAE6OF02IMN1M.24.53.E09.1.454.CMB.1.raw
  modified_base (181)..(181): a, c, t, g, unknown or other
  misc_feature (181)..(181): n is a, c, g, or t
  modified_base (286)..(286): a, c, t, g, unknown or other
  misc_feature (286)..(286): n is a, c, g, or t
  modified_base (417)..(417): a, c, t, g, unknown or other
  misc_feature (417)..(417): n is a, c, g, or t
  modified_base (422)..(434): a, c, t, g, unknown or other
  misc_feature (422)..(434): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagcccccaaatcctcatttancgtaacaacaatcggccctctggggtccctgaccgattctccgcctccaagtctggcacctcagcctcgctggccatcactgggctccaggctgagatgagggtnattactactgccagtcgtcgaagatgttcggcggagggactaagctgaccgtctaggcagcccaaggctcgcccctggtcactctcgtcccaccctcctcacatagtagtctgagcgggctggcaaggcgnatagnnnnnnnnnnnnn

SEQ ID NO: 264560 - DNA, 540 bp, Homo sapiens
  misc_feature: GYAE6OF02FOM81.24.53.E09.1.454.CMB.1.raw
  modified_base (436)..(436): a, c, t, g, unknown or other
  misc_feature (436)..(436): n is a, c, g, or t
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcactggagtcgcatctgaatacttccagcagttgggccagggcacccgtggtcaccgtctcctcagcctccaccgaacgggccccatccggtccttcccccgnggccgccctcgcctccaggacgccacctccgagacgcacacgccggcccgtgggccgtcgccgtcggtaccgaacggactaccttccacagtagtacgtctcgg

SEQ ID NO: 264561 - DNA, 439 bp, Homo sapiens
  misc_feature: GYAE6OF02FQOZZ.24.53.E09.1.454.CMB.1.raw
  modified_base (431)..(439): a, c, t, g, unknown or other
  misc_feature (431)..(439): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtcctgagcgggctggcaaggcgcatagnnnnnnnnn

SEQ ID NO: 264562 - DNA, 552 bp, Homo sapiens
  misc_feature: GYAE6OF02I12Z6.24.53.E09.1.454.CMB.1.raw
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (543)..(543): a, c, t, g, unknown or other
  misc_feature (543)..(543): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactcgtgtgaagggccgattcaccatctccagagacaacgcccagaactcactgtatctggaaatgaaccagcctagagagtcgaggacacggctatgtattacgtgtgccgaaccatatcagccacgtggatcgacatctagaatctccagcagttcgggcagggcacctgcacgtntccnacgccctcaacgacggcccatccgtccctcccgngcccnccctgcctcgacggcnccaccgtccgagacgccacgacgcccggccgttcgggacctcggccctggaacccgaacgtaacctacccggatacggtacgtacgtaccgnggaaccggg

SEQ ID NO: 264563 - DNA, 288 bp, Homo sapiens
  misc_feature: GYAE6OF02H8XVN.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccgccctcctcacatagtagtctgagcgggctggcaaggcgcatagnnnnnnnnn

SEQ ID NO: 264564 - DNA, 611 bp, Homo sapiens
  misc_feature: GYAE6OF02I2FIG.24.53.E09.1.454.CMB.1.raw
  modified_base (227)..(227): a, c, t, g, unknown or other
  misc_feature (227)..(227): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (582)..(586): a, c, t, g, unknown or other
  misc_feature (582)..(586): n is a, c, g, or t
  modified_base (588)..(599): a, c, t, g, unknown or other
  misc_feature (588)..(599): n is a, c, g, or t
  modified_base (601)..(611): a, c, t, g, unknown or other
  misc_feature (601)..(611): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacacgacccccaaactcctcatttatcgtaacaacaatcgcctcgtcgggtccctgaccgattccnccgcctccaagtctcgccacctcacgcctcgctcggccatccacgtgggctccgaggctggacggatggagggtgtaatttaccgattcgaccgagttccggtacgaaagtgtcggttcggagggaacggaactaacgctacggaacccgttccgaacgggttccaaccggacccgaaggggtccctcccggtcccccccgttgggtacccaccgttcccgttccggttacccccccaacccctttcccggtcctaaacgttaacgtttaacggtaacggtttccgttacggaacggggtccgggtacccgttcgggaaccgaaagggggcccaactaaggttacgngtncngcnnnnngnnnnnnnnnnnngnnnnnnnnnnn

SEQ ID NO: 264565 - DNA, 553 bp, Homo sapiens
  misc_feature: GYAE6OF02GVZF7.24.53.E09.1.454.CMB.1.raw
  modified_base (172)..(172): a, c, t, g, unknown or other
  misc_feature (172)..(172): n is a, c, g, or t
  modified_base (334)..(334): a, c, t, g, unknown or other
  misc_feature (334)..(334): n is a, c, g, or t
  modified_base (444)..(444): a, c, t, g, unknown or other
  misc_feature (444)..(444): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (499)..(501): a, c, t, g, unknown or other
  misc_feature (499)..(501): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagactactatgtcacgaccggtgctcgatttagagagagtgtgttgggtttggggctgtttttgggaagctgcttgtaccagagggtccaccactctcctcgcacttgggagtcgaacatcggcgcaggttttgaatgtccacgtggtacaagcaggcttaccgaaaacngcccccaaattccgttcatttatcgttaacaactaatccggccctcgtggggtaccctgaccgattctccggcctccgaagtctggccacctcagcctcgctggccatcactgggctccaggctgagactgaggtgattactactgcctagtcgtcgaacgntggtcggcgggagggactagcgtggaccgtcgtaggccacgacccaaaggcctcggacccccttggtcctacgtcctcgtccccacccttccctccactagtagtcgtcncggagccgggtctcggacgacggacgctagtagctacgnancngntacngtctannnacacacgacgacgacgacgngagntntntgtgtgtntntctntcgtctgtcg

SEQ ID NO: 264566 - DNA, 311 bp, Homo sapiens
  misc_feature: GYAE6OF02F2P4P.24.53.E09.1.454.CMB.1.raw
  modified_base (229)..(229): a, c, t, g, unknown or other
  misc_feature (229)..(229): n is a, c, g, or t
  modified_base (282)..(311): a, c, t, g, unknown or other
  misc_feature (282)..(311): n is a, c, g, or t
tcagactactatgtcacgaccggtgctcgatttagagagagtgtgttggggtttgggggtgtggtggtctccactcccgccttgacgggctgctatctgcctcgctggccatcactgggctccagggctgaggatggagggtgattactactgccagtcgtcgaagatgttcgggcggagggactaagctgaccgtcctaggtcagcccaaggctgcccctgtcactcngttccccgccctctcacatagtagtctgagcgggctggacaagggcacatagnnnnnnnnnnnnnnnnnnnnnnnnnnnnnn

SEQ ID NO: 264567 - DNA, 581 bp, Homo sapiens
  misc_feature: GYAE6OF02HD9A8.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattcggggccagggcacccgtggtcaccgtctcctcacgcctccaccacgggcccagttccggtccttcccccgtcggcccgtcccctcgccctcccgacgggacgccgacccgtccgacgacgccaccgacgcccggcccgtgggccgtcggcccgttgggtaccaaacgggtacccttaccgttcccaaccgtaagttacggttacgtcgtacggg

SEQ ID NO: 264568 - DNA, 459 bp, Homo sapiens
  misc_feature: GYAE6OF02H3H4T.24.53.E09.1.454.CMB.1.raw
  modified_base (163)..(163): a, c, t, g, unknown or other
  misc_feature (163)..(163): n is a, c, g, or t
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (442)..(459): a, c, t, g, unknown or other
  misc_feature (442)..(459): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaactcctcatttatcgtaacaacaatcggccctctggggtccctgaccgattcctccgcctccaagtctggccacctcagcctcgctcggccatcacgtgggcctccaggctggaggatggagggtgattactactgcccagtcgtacgaagattgtcggcggaggactaagctgaccgtcgtaggtcacgcccaaggctcgccccgtgtcactctcgttcccaccctccncacatagtagtctgacgcggctggacgacggcganagtagnnnnnnnnnnnnnnnnnn

SEQ ID NO: 264569 - DNA, 436 bp, Homo sapiens
  misc_feature: GYAE6OF02I2TVR.24.53.E09.1.454.CMB.1.raw
  modified_base (161)..(161): a, c, t, g, unknown or other
  misc_feature (161)..(161): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (427)..(436): a, c, t, g, unknown or other
  misc_feature (427)..(436): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctggtcactctcgttcccaccctcctcacatagtanctgagcgggctggcaaggcncatagnnnnnnnnnn

SEQ ID NO: 264570 - DNA, 602 bp, Homo sapiens
  misc_feature: GYAE6OF02I8R6G.24.53.E09.1.454.CMB.1.raw
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
  modified_base (453)..(453): a, c, t, g, unknown or other
  misc_feature (453)..(453): n is a, c, g, or t
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccgagggacggggctggaggtgggtggccaatataaggcacgatggacgtagcatgtactatgtggactctgtgaagggccattcaccatctccaganacaacgcccagaactcactgtatctggaaatgaccagcctgagagtcgaggacacggctatgtattactgtgcgaccatatcagcaccgtggagtcganatctagaaatacctccgagctagttcggggaccagggcctaccctggtccaccgtctcctcacgcctcccaaccaacgggccctagtccggtcccttcccccgnggcccgtccctcgccgtccgacggacgccaccctaccggacgacgaccaaccgacgccggacccgtcgggcctccggccgttacgggaccgtaaacggtaccgttaacccttacccaaccgtacgttaacggttacgttccgtaacggg

SEQ ID NO: 264571 - DNA, 463 bp, Homo sapiens
  misc_feature: GYAE6OF02HDC8U.24.53.E09.1.454.CMB.1.raw
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (432)..(463): a, c, t, g, unknown or other
  misc_feature (432)..(463): n is a, c, g, or t
tcagactactatgtcacgaccggtgctcgatttagagagagtgtgttgggtttgggggctgttttggagctgcttgtaccagagggtcaccatctcctgcactgggagcaacatcggcgcaggttttgatgtccactggtacaagcagcttaccaaaaaacngcccccaaatcctcatttatcgtaaacaacaatcggccctntcggggtccctgaccgattcctccgcctccaaagtctggccacctnacgcctcgctggccatcactgggctccgaggctgagatgagggtnattacactgccagtcgtcgaagntgtcggnggaggactaagctcgaccgtcctaggtcaagcccaaggctcgcccctgtcactctcgtccccncctcgnactatagtagtctgagcggtctgacgaaggcacagtagnnnnnnnnnnnnnnnnnnnnnnnnnnnnnnnn

SEQ ID NO: 264572 - DNA, 286 bp, Homo sapiens
  misc_feature: GYAE6OF02FK8QL.24.53.E09.1.454.CMB.1.raw
  modified_base (280)..(286): a, c, t, g, unknown or other
  misc_feature (280)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnnnnn

SEQ ID NO: 264573 - DNA, 283 bp, Homo sapiens; identical to SEQ ID NO: 264510
  misc_feature: GYAE6OF02GPTYK.24.53.E09.1.454.CMB.1.raw
  modified_base (280)..(283): a, c, t, g, unknown or other
  misc_feature (280)..(283): n is a, c, g, or t

SEQ ID NO: 264574 - DNA, 583 bp, Homo sapiens
  misc_feature: GYAE6OF02GH9TL.24.53.E09.1.454.CMB.1.raw
  modified_base (482)..(482): a, c, t, g, unknown or other
  misc_feature (482)..(482): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacgggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctagaatacttccagcagttggggccagggccacccgtggtccaccgtctcctcacgcctcccaccgaacggcccagtccggtccttcccccgtcggcccgccctcgcctcccgacggcgccacccgtccgacgacnccaacgacggccggccccgtgggcccgtcggcccgttcggggtaccctaaacgggtacccttaccgttcccaacctaacgttacggttacgtccgtacggg

SEQ ID NO: 264575 - DNA, 462 bp, Homo sapiens
  misc_feature: GYAE6OF02G0IJ1.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (442)..(462): a, c, t, g, unknown or other
  misc_feature (442)..(462): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttancgtaacaacaatccggccctctggggtccctgaccgattctccgcctccaagtctggcacctcagcctgctggccatcactgggctccaggctgaggatgagggtgattacactgccagtcgtacgaagatggttcggcggagggactaagctgaccgtcctaggtcacggcccaaggctcgcccccgtggtcacctctcgttcccaccctctcacatagtagtctggacgcgggtctgggcaaggccgacgattacggnnnnnnnnnnnnnnnnnnnnn

SEQ ID NO: 264576 - DNA, 279 bp, Homo sapiens
  misc_feature: GYAE6OF02FPYM8.24.53.E09.1.454.CMB.1.raw
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgcccctcggtcactctgttccccaccctcctcacatagtagtctgagcgggctggcaaggcgcatag

SEQ ID NO: 264577 - DNA, 283 bp, Homo sapiens
  misc_feature: GYAE6OF02G2SRC.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccgccctcctcacatagtagtctgagcgggctggcaaggcgcatagnn

SEQ ID NO: 264578 - DNA, 326 bp, Homo sapiens
  misc_feature: GYAE6OF02JCL6T.24.53.E09.1.454.CMB.1.raw
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (287)..(326): a, c, t, g, unknown or other
  misc_feature (287)..(326): n is a, c, g, or t
tcagactactatgtcacgaccggtgctcgatttagagagagtgtgttggggtttgggggtgtggtggtctccactcccgccttgacggggctgctatctgcctcgctggccatcactggctccaggctgaggatgagggtgattactactgccagtcgtcgaagatgttcggcggagggactaagctgaccgtctaggtcagcccaaggctgcccctggtcactctcgttccccacctcctcacatacgtatctgagcgggctggcaaggcgacatagnagntnacnnnnnnnnnnnnnnnnnnnnnnnnnnnnnnnnnnnnnnnn

SEQ ID NO: 264579 - DNA, 554 bp, Homo sapiens
  misc_feature: GYAE6OF02JA2OB.24.53.E09.1.454.CMB.1.raw
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (486)..(486): a, c, t, g, unknown or other
  misc_feature (486)..(486): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctagaataccttccagctagttcggggccagggccacccgtggtaccaccgtctcctcacgcctcccaccgaacgggcccattccggtccttccccgnggccctccctgcctccgaggcnccaccgtccgagacacacncggccggcccgtgggcctcggccgtggtaccacggaccttacgtcccaatacgtaggtactcgtacgg

SEQ ID NO: 264580 - DNA, 461 bp, Homo sapiens
  misc_feature: GYAE6OF02IAQE5.24.53.E09.1.454.CMB.1.raw
  modified_base (162)..(162): a, c, t, g, unknown or other
  misc_feature (162)..(162): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (451)..(461): a, c, t, g, unknown or other
  misc_feature (451)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaactcctcattttatcgtaacaacaatcggccctctggggtccctgaccgattctccgcctccaagtctggcacctcagcctcgctggccatcactggctccaggctgaggatggagggtnattactactgccagtcgtcgaagntgttcggnggagggactaagctgaccgtcctatgtacacgcccaagggcctcggccccctcggtcactctcgttccccaccctcctcactatagtcgtctggaggccgggctgggacgaacgggcgaccagtagnnnnnnnnnnn

SEQ ID NO: 264581 - DNA, 433 bp, Homo sapiens
  misc_feature: GYAE6OF02GWO8Z.24.53.E09.1.454.CMB.1.raw
  modified_base (161)..(161): a, c, t, g, unknown or other
  misc_feature (161)..(161): n is a, c, g, or t
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
  modified_base (421)..(433): a, c, t, g, unknown or other
  misc_feature (421)..(433): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggnggagggactaagctgaccgtctagtcagcccaaggctgcccctgtcactctgttcccncctcctcacatagtagtctgagcgggctggcgaaggcgcatacgnnnnnnnnnnnnn

SEQ ID NO: 264582 - DNA, 285 bp, Homo sapiens
  misc_feature: GYAE6OF02FTWNM.24.53.E09.1.454.CMB.1.raw
  modified_base (279)..(285): a, c, t, g, unknown or other
  misc_feature (279)..(285): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnnnnn

SEQ ID NO: 264583 - DNA, 323 bp, Homo sapiens
  misc_feature: GYAE6OF02GLOUQ.24.53.E09.1.454.CMB.1.raw
  modified_base (292)..(323): a, c, t, g, unknown or other
  misc_feature (292)..(323): n is a, c, g, or t
tcagactactatgtcacgaccggtgctcgatttagagagagtgtgttggggtttggggggtggtggtggtctccactcccgccttgacggggctgctatctgcctcgctggccatcactgggctccaggctgaggatggagggtgattactacgtgccagtcgtcgaagatgttcggcggagggactaagcgtgaccgtcctaggtcagcccaaggctgccccctggtcactctcgttccccaccctcctcacattagtagtctgagcgggtctggacaaggcacaatacgnnnnnnnnnnnnnnnnnnnnnnnnnnnnnnnn

SEQ ID NO: 264584 - DNA, 495 bp, Homo sapiens
  misc_feature: GYAE6OF02GOJK5.24.53.E09.1.454.CMB.1.raw
  modified_base (165)..(165): a, c, t, g, unknown or other
  misc_feature (165)..(165): n is a, c, g, or t
  modified_base (461)..(471): a, c, t, g, unknown or other
  misc_feature (461)..(471): n is a, c, g, or t
  modified_base (473)..(495): a, c, t, g, unknown or other
  misc_feature (473)..(495): n is a, c, g, or t
tcagactactatgtcacgaccggtgctcgatttagagagagtgtgttgggtttggggggctgtttttggaagctgcttgtaccagagggtcaccatcctcctgcactgggagcaacatcggcgcaggttttgatgtccactggtacaagcagctttccaaaaacngccccccaaactccctcattttatcgtaacaacaatcggccctctggggtccctgaccgattctccgcctccaagtctggcacctcagcctcgctggccatccactgggacctcccgaggcctgacggatggagggtgattactactgccagtcgtcgaagatgttcggcggagggactaagctgaccgtcgtaggtcagcccaaggctcgccccctggcactcttcgttcccaccctccacacatacgtagtctgacgcgggctacggacgtaacgggccgacgtatacgtgacnnnnnnnnnnncnnnnnnnnnnnnnnnnnnnnnnn

SEQ ID NO: 264585 - DNA, 574 bp, Homo sapiens
  misc_feature: GYAE6OF02GRGY0.24.53.E09.1.454.CMB.1.raw
  modified_base (164)..(164): a, c, t, g, unknown or other
  misc_feature (164)..(164): n is a, c, g, or t
  modified_base (317)..(317): a, c, t, g, unknown or other
  misc_feature (317)..(317): n is a, c, g, or t
  modified_base (546)..(574): a, c, t, g, unknown or other
  misc_feature (546)..(574): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgaccccccaaaactccctcattttactcgtaaacaaacaatccggcccctcgtcggggtccctgacccgattcctccgcctaccaagtctcggccacctcacgccctcgctcggccatccactgggcctcccgaggcctgaggatggaggtnaattactactcgcctagtcgtacgaagtattggtcgggacgggagggaactaagcgtacggacccgttccgtagggtccaacgaccccgaaaggccgttccggcccccccgttgggtaccctaccgttccgttcccggttccccccgccccttccctcgaacctaacgttacgtaacgtcgtaggacgggtccgggacgtcggacgaaacgggtccgacgtaatacggnnnnnnnnnnnnnnnnnnnnnnnnnnnnn

SEQ ID NO: 264586 - DNA, 610 bp, Homo sapiens
  misc_feature: GYAE6OF02IB2R8.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaacctcactgtatctaggaaatgaccagcctgagagtcgaggacacggctatgtattactgtgcgaccatatcagccaccgtggacgtcgcatctagaaacttaccttccagctaggttcggggcccaggggcccacccgtcggtcctacccgtcctccctccgcgccctcccgaacccgaaccgggcccctacgttcccggttcccttcccccgtcgggtcccgtccccgtcggccctccgacggaccgcccacccgtaccgacgacgcaccgcgccggcccgtgggcctcggccgtcggtaccgtaacggtaccttaccgttaccacgtacgtacggtacgtcgtacgg

SEQ ID NO: 264587 - DNA, 452 bp, Homo sapiens
  misc_feature: GYAE6OF02H94YX.24.53.E09.1.454.CMB.1.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
  modified_base (437)..(452): a, c, t, g, unknown or other
  misc_feature (437)..(452): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactccctcattttatcgtaaacaacaatcggccctctggggtcccctgaccgattctccgcctccaagtctggcacctcagcctcgctggccatcactgggctccaggctgagatgagggtnattactactgcccagttcgtcgaagntcggttcggcggagggactaagctgaccgtcctaggtcagcccaaggcctcgcccctggcactctcgtcccaccctctcacntagtagtctgacggcggctggcaagggcncatagnnnnnnnnnnnnnnnn

SEQ ID NO: 264588 - DNA, 283 bp, Homo sapiens
  misc_feature: GYAE6OF02HKKEF.24.53.E09.1.454.CMB.1.raw
  modified_base (282)..(283): a, c, t, g, unknown or other
  misc_feature (282)..(283): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctgttccccgccctcctcacatagtagtctgagcgggctggcaaggcgcatagnn

SEQ ID NO: 264589 - DNA, 485 bp, Homo sapiens
  misc_feature: GYAE6OF02IMSTD.24.53.E09.1.454.CMB.1.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (403)..(403): a, c, t, g, unknown or other
  misc_feature (403)..(403): n is a, c, g, or t
  modified_base (453)..(485): a, c, t, g, unknown or other
  misc_feature (453)..(485): n is a, c, g, or t
tcagactactatgtcacgaccggtgctcgatttagagagagtgtgttgagtttggggctgtttttggaagctgcttgtaccagagggtcaccatctcctgcactggggagcaacatcggcgcaggttttgatgtccactggtacaagcagcttaccaaaaacacgcccccaaaactcctcatttatcgtaacaacaatcggccctctcggggtccctgaccgattcctccgcctcaagtctggcacctnagcctcgctggccatcactgggctccaggctgaggatggagggtnattactactgccagtcgtcgaagntgtcggacggagggactaagcttgaccgtctaggtcagcccgaaggcctcggcccccctggtacactctcgttccccacccttcncactatagtacgtctgacgcgggtctggacgaacggtcgactaatacgcnnnnnnnnnnnnnnnnnnnnnnnnnnnnnnnnn

SEQ ID NO: 264590 - DNA, 282 bp, Homo sapiens
  misc_feature: GYAE6OF02IGX0T.24.53.E09.1.454.CMB.1.raw
  modified_base (280)..(282): a, c, t, g, unknown or other
  misc_feature (280)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctcggtcactctcgttcccaccctcctcacatagtagtctgagcgggctggcaaggcgcatagnnn

SEQ ID NO: 264591 - DNA, 654 bp, Homo sapiens
  misc_feature: GYAE6OF02IYN06.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaagggccattcaccatctccagagacaacgcccagaactcactgtatctggaaatgaccagcctgagagtcgagacacggctatgtatactgtgcgacatatcagcaccgtggagtccgactatctaggtaataccgtttaccagtacctagtttcggggggacccaacgggggccctaacccgttcgggtacccgtaacccggttcccgtccccgttcgaccgtccctacccgaacccgtaaaccggggcccctaacgttccgggttcccttacccccgtcgggcccgtcccgtcgcccgttacccgacggaccgtaccacccgttcccgagaccgtccgaaccgacggcccggtcccgtcggcccgtcggtcccgtaggtaccgtaacgtaccgttaccttccgaactacgttacggtacttcgtacgg

SEQ ID NO: 264592 - DNA, 157 bp, Homo sapiens
  misc_feature: GYAE6OF02IDDHP.24.53.E09.1.454.CMB.1.raw
  modified_base (155)..(157): a, c, t, g, unknown or other
  misc_feature (155)..(157): n is a, c, g, or t
tcagactactatgtcacgaccggtgctcgatttagagagagtgtgttgggtttgggggaagaggaagactgacggtcctgccacagcggccctgggctgcctggtcaaggactacttccacatagtagtctgagcgggctggcaaggcgcatagnnn

SEQ ID NO: 264593 - DNA, 460 bp, Homo sapiens
  misc_feature: GYAE6OF02HG9NL.24.53.E09.1.454.CMB.1.raw
  modified_base (432)..(432): a, c, t, g, unknown or other
  misc_feature (432)..(432): n is a, c, g, or t
  modified_base (439)..(440): a, c, t, g, unknown or other
  misc_feature (439)..(440): n is a, c, g, or t
  modified_base (442)..(460): a, c, t, g, unknown or other
  misc_feature (442)..(460): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatggagggtgattactactgcccagtcgtcgaagatgtcggcggagggactaagctgaccgtcctaggtcagcccaaggctcgcccctggtcactctcgttccccaccctcctcactatacgtacgtctggacgccgggctggcaagggcncagtagnngnnnnnnnnnnnnnnnnnnn

SEQ ID NO: 264594 - DNA, 482 bp, Homo sapiens
  misc_feature: GYAE6OF02JBKAY.24.53.E09.1.454.CMB.1.raw
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (226)..(226): a, c, t, g, unknown or other
  misc_feature (226)..(226): n is a, c, g, or t
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
  modified_base (460)..(482): a, c, t, g, unknown or other
  misc_feature (460)..(482): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttancgtaaacaacaatccggccctcgtggggtcccctgaccgattccncccgcctccaagtctggccacctcagccctcgctggccatcacgtggctaccaggctggaggatggagggtgattactactcgccctagtcgtacgaagngttggtcggcgggagggactaagctgaccgtccaggtcacgcccaaggctccgccccgtgtcnctcctcgttccccgccctctcactatacgtacgtcgtgacggcgggtctcggacgaaggccgactagacgnnnnnnnnnnnnnnnnnnnnnnn

SEQ ID NO: 264595 - DNA, 280 bp, Homo sapiens
  misc_feature: GYAE6OF02F7P33.24.53.E09.1.454.CMB.1.raw
  modified_base (272)..(272): a, c, t, g, unknown or other
  misc_feature (272)..(272): n is a, c, g, or t
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgggggtgattactactgccagtcgtcgaagatgttcggcggaggactaagctgaccgtcctaggtcagcccaaggctgccccctcggtcactctgttcccgccctcctcacatagtagtctgagcggctggcaaggcncatagnnn

SEQ ID NO: 264596 - DNA, 474 bp, Homo sapiens
  misc_feature: GYAE6OF02FSPUW.24.53.E09.1.454.CMB.1.raw
  modified_base (110)..(110): a, c, t, g, unknown or other
  misc_feature (110)..(110): n is a, c, g, or t
  modified_base (238)..(238): a, c, t, g, unknown or other
  misc_feature (238)..(238): n is a, c, g, or t
  modified_base (385)..(390): a, c, t, g, unknown or other
  misc_feature (385)..(390): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (434)..(435): a, c, t, g, unknown or other
  misc_feature (434)..(435): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (443)..(444): a, c, t, g, unknown or other
  misc_feature (443)..(444): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (461)..(462): a, c, t, g, unknown or other
  misc_feature (461)..(462): n is a, c, g, or t
  modified_base (464)..(465): a, c, t, g, unknown or other
  misc_feature (464)..(465): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
tcagactactatgtcacgaccggtgctcgatttagagagagtgtgttgggtttgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatggagggtnattactactgccagtcgtcgaagatggttcggcggagggactaaggctgaccgtcctaggtcagcccaaggctgccccctggtcactctcgttcccaccctcctcacattagtacgtctgacgcgggcctggccaaggcgcatacgnnnnnngncgncncgntcntancgatcangcngtcatcagctnagtccgnnctncnctnntgcngtcngtcntcganncnncagncgncg

SEQ ID NO: 264597 - DNA, 462 bp, Homo sapiens
  misc_feature: GYAE6OF02IEZWO.24.53.E09.1.454.CMB.1.raw
  modified_base (163)..(163): a, c, t, g, unknown or other
  misc_feature (163)..(163): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (429)..(429): a, c, t, g, unknown or other
  misc_feature (429)..(429): n is a, c, g, or t
  modified_base (431)..(462): a, c, t, g, unknown or other
  misc_feature (431)..(462): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcattttatcgtaacaacaatccggccctctggggtccctgaccgattctccgcctccaagtctggcacctcagcctcgctggccatcactggctcaggctgagatgagggtntattactactgccagtcgtacgaagntgtcggnggaggactagctgaccgtcagtcacgcccagctcgccccgtgtcactctcgtcccacctcctcacatagtctcgtgacgtcgggctggacgaacggcgctagtagntnnnnnnnnnnnnnnnnnnnnnnnnnnnnnnnn

SEQ ID NO: 264598 - DNA, 455 bp, Homo sapiens
  misc_feature: GYAE6OF02GERJ1.24.53.E09.1.454.CMB.1.raw
  modified_base (313)..(313): a, c, t, g, unknown or other
  misc_feature (313)..(313): n is a, c, g, or t
  modified_base (439)..(455): a, c, t, g, unknown or other
  misc_feature (439)..(455): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactcctcatttatcgtaacaacaatcggccctctggggtccctgaccgattctccgcctccaagtctggcacctcagcctcgctggccatcactgggctccaggctgaggatgaggtgattacactgccagtcgtcgaagntggttcggcggagggactaagctgaccgtcctaggtcacgcccaaggctcgcccctggtcactctcgttccccaccctcctcacatagtacgtctgacgcgggtctgggccaagggccgacagtgnnnnnnnnnnnnnnnnn

SEQ ID NO: 264599 - DNA, 471 bp, Homo sapiens
  misc_feature: GYAE6OF02IWZMJ.24.53.E09.1.454.CMB.1.raw
  modified_base (162)..(162): a, c, t, g, unknown or other
  misc_feature (162)..(162): n is a, c, g, or t
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
  modified_base (441)..(471): a, c, t, g, unknown or other
  misc_feature (441)..(471): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaaacaacaatcggccctctggggtccctgaccgattccnccgcctccaagtctggcacctcacgcctcgctggccatccactggctccaggctgaggatggaggtgacttactactgccagtcgtcgaagatgtcggcggaggactaagctgaccgtccaggtcagcccagccncgcccctggtcactctcgttcccgccctcctcactatagtacgtctgacgccgggctcggcgtaacggcgcacgtagcgannnnnnnnnnnnnnnnnnnnnnnnnnnnnnn

SEQ ID NO: 264600 - DNA, 517 bp, Homo sapiens
  misc_feature: GYAE6OF02F2GU3.24.53.E09.1.454.CMB.1.raw
  modified_base (163)..(163): a, c, t, g, unknown or other
  misc_feature (163)..(163): n is a, c, g, or t
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
  modified_base (492)..(517): a, c, t, g, unknown or other
  misc_feature (492)..(517): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaaactccctcatttatcgtaacaacaatcggccctctggggtccctgaccgattcnccgcctccaagtctggcacctcagcctcgctggccatcactgggctccaggctgaggatggaggtntattacacgtgccctaggtcgtacgaagtatcggttccgggcgggagggtaactaaggcctcgacccgttccgtaggtcacgccccgaaggcctccgcccccgtggtcctacgttcctccgttcccccacccttcccaccaactatacgtacgtcgtcggacggcgggtacgtcgggacgaacgggccgactagtagcnnnnnnnnnnnnnnnnnnnnnnnnnn

SEQ ID NO: 264601 - DNA, 284 bp, Homo sapiens; identical to SEQ ID NO: 264444
  misc_feature: GYAE6OF02I7C48.24.53.E09.1.454.CMB.1.raw
  modified_base (281)..(284): a, c, t, g, unknown or other
  misc_feature (281)..(284): n is a, c, g, or t

SEQ ID NO: 264602 - DNA, 286 bp, Homo sapiens; identical to SEQ ID NO: 264572
  misc_feature: GYAE6OF02GKKPT.24.53.E09.1.454.CMB.1.raw
  modified_base (280)..(286): a, c, t, g, unknown or other
  misc_feature (280)..(286): n is a, c, g, or t

SEQ ID NO: 264603 - DNA, 493 bp, Homo sapiens
  misc_feature: GYAE6OF02H5N3W.24.53.E09.1.454.CMB.1.raw
  modified_base (162)..(162): a, c, t, g, unknown or other
  misc_feature (162)..(162): n is a, c, g, or t
  modified_base (282)..(283): a, c, t, g, unknown or other
  misc_feature (282)..(283): n is a, c, g, or t
  modified_base (312)..(312): a, c, t, g, unknown or other
  misc_feature (312)..(312): n is a, c, g, or t
  modified_base (461)..(493): a, c, t, g, unknown or other
  misc_feature (461)..(493): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaatccctcatttatcgtaacaacaatcggccctctggggtccctgaccgattcctccgctccaagtcctggccacctcagcctcgctggccatcactggctccaggctgagnngagggtattacactgccagtcgtacgaanattggttcggcggaaggactaaaggctgacccgtcgtagtcacgcccaagtcctcgccccctaggtccacgttcctccgttcccccacccttcctacacattaagtctccgtggacgccgggtctgggaccgaaggcgactaagtacgnnnnnnnnnnnnnnnnnnnnnnnnnnnnnnnnn

SEQ ID NO: 264604 - DNA, 455 bp, Homo sapiens
  misc_feature: GYAE6OF02G9BXV.24.53.E09.1.454.CMB.1.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (419)..(419): a, c, t, g, unknown or other
  misc_feature (419)..(419): n is a, c, g, or t
  modified_base (434)..(455): a, c, t, g, unknown or other
  misc_feature (434)..(455): n is a, c, g, or t
tcagactactatgtcacgaccggtgctcgatttagagagagtgtgttgggggtttgggggctgttttggaagctgcttgtaccgagaggtcaccatctcctgcactgggagcaacatcggcgcaggttttgatgtccacgtggtacaagcagcttccaaaaactagcccccaaatccctcatttactcgtaacaacaatccggccctcgtggggtccctggaccgattcctccgcctccaagtcctggccacctcagcctcgctggccatcactggcctcagctagagatggaggtnacttacactgcccagtcgtcgaagntggttcggcggagggactaggctgaccgtctaggtcagcccaaggctcgcccctggtcactctcgttcccaccctctcacatacgatctggagcggntggacaggcatatgnnnnnnnnnnnnnnnnnnnnnn

SEQ ID NO: 264605 - DNA, 437 bp, Homo sapiens
  misc_feature: GYAE6OF02GC3NK.24.53.E09.1.454.CMB.1.raw
  modified_base (161)..(161): a, c, t, g, unknown or other
  misc_feature (161)..(161): n is a, c, g, or t
  modified_base (426)..(437): a, c, t, g, unknown or other
  misc_feature (426)..(437): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttcccgccctcctcacatagtatctgacgcgggctggcaaggcgcatgnnnnnnnnnnnn

SEQ ID NO: 264606 - DNA, 534 bp, Homo sapiens
  misc_feature: GYAE6OF02I5X5C.24.53.E09.1.454.CMB.1.raw
  modified_base (162)..(162): a, c, t, g, unknown or other
  misc_feature (162)..(162): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (508)..(510): a, c, t, g, unknown or other
  misc_feature (508)..(510): n is a, c, g, or t
  modified_base (512)..(519): a, c, t, g, unknown or other
  misc_feature (512)..(519): n is a, c, g, or t
  modified_base (521)..(534): a, c, t, g, unknown or other
  misc_feature (521)..(534): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaaacaacaatcggccctcgtggggtccctgaccgattcctccgcctccaagtctggcacctcagcctcgctggccatcactgggctccaggctgaggatggagggtnattactacgtgcccaggtcgtacgaagtntggtcggacggaggtacaagctcgaccgtcgtaggtcacgcccgaaggcctccggcccccgtggtccaccttcgtacgttcccccacccttcgtaccacgtactacgtacgtctacggacggtccgggtcgttgggaccgaaacgggtccgaccgtaagttacggctcancgcncgcgngancgcnnncnnnnnnnngnnnnnnnnnnnnnn

SEQ ID NO: 264607 - DNA, 572 bp, Homo sapiens
  misc_feature: GYAE6OF02FKGFJ.24.53.E09.1.454.CMB.1.raw
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
  modified_base (434)..(434): a, c, t, g, unknown or other
  misc_feature (434)..(434): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (521)..(522): a, c, t, g, unknown or other
  misc_feature (521)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
tcagactactatgtcacgaccggtgctcgattttagagagagtgtggttgaggtttgggggctgtttttaggaagctgcttgtaccagagggtcaccatctccctgcactgggagcaaacatcggcgcagggttttgatgtccactggtacaagcagcttccaaaaaacacgcccccaaactcctccatttatacgtaacaacaatcggccctcgtcgggtccctgaccgattcctccgcgtccaagtcnggcacctcacgcctcgcgtcggccagtcacncggcctaccgaggtctgaaggatggagggtgacttacgtcgtcgccgaagtccgtagaagtgtcggtcggngggagggtactaacgtcgtgtaccgtcgtaggtcgacgaccgaagtcctaccgccccgtggtaccacgtccgtcgttccccncctccacactagtagtctccgtgacggacggctacggacgtaacgggtcacgtagacggtncgtcncacgncgacgngacgtntgtnngngngngngcgcgngtgtagtactagtgtagtcgtgtgtcgtggaggacg

SEQ ID NO: 264608 - DNA, 285 bp, Homo sapiens; identical to SEQ ID NO: 263615
  misc_feature: GYAE6OF02HKV7I.24.53.E09.1.454.CMB.1.raw
  modified_base (280)..(285): a, c, t, g, unknown or other
  misc_feature (280)..(285): n is a, c, g, or t

SEQ ID NO: 264609 - DNA, 752 bp, Homo sapiens
  misc_feature: GYAE6OF02I4FJI.24.53.E09.1.454.CMB.1.raw
  modified_base (220)..(220): a, c, t, g, unknown or other
  misc_feature (220)..(220): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccaggggacgggctggagtgggtggccaatataaggcacgatggacgtagcatgtactatgtggacctntgtaggacgggctacttcaccatcctcagacgacaaccgcccaanactcactgtatcgaggtaancacgacacgtcgtaggacgtacggacggacggaccgcgttagtacgttacgttaacgtcggtcggtacaccgtaactagtacacgacgtccgaggttacgccgtcgtactactacgtacttaacctacgtacgagtcggttacgggaccggaccggtacccgtccgtaccggttaccgtaccctacgttccccgtcgacccgtaccggtaccccaacccgggtaaccgacccggtaccgttccggttcccccgtttccccgttcccccgggtcccgttcccgtcccgtaccggtaccctaccgggaacggtacccacccgtaaccggacgtaaaccgaccgaaacccgccgggttaccccggggccgttaccgggtccggtacccggttccgggtaccggttaaccggtaccggtaaccggttcccttaaccgtaccgtaggttaaccgttacggttaccggtacgg

SEQ ID NO: 264610 - DNA, 443 bp, Homo sapiens
  misc_feature: GYAE6OF02GXG99.24.53.E09.1.454.CMB.1.raw
  modified_base (429)..(443): a, c, t, g, unknown or other
  misc_feature (429)..(443): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactatcgttcccaccctctcacatagtagtctgacgcgggctggcaaggcgcatagnnnnnnnnnnnnnnn

SEQ ID NO: 264611 - DNA, 433 bp, Homo sapiens
  misc_feature: GYAE6OF02F95TM.24.53.E09.1.454.CMB.1.raw
  modified_base (425)..(433): a, c, t, g, unknown or other
  misc_feature (425)..(433): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactggctccaggctgaggatgagggtgattactactgccagtcgtcgaagatgttcggcggagggactaagctgaccgtcctaggtcagcccaaggctgccccctggtcactctgtcccaccctcctcacatagtagtctgagcgggctggcaaggcgcatagnnnnnnnnn

SEQ ID NO: 264612 - DNA, 299 bp, Homo sapiens
  misc_feature: GYAE6OF02H22TF.24.53.E09.1.454.CMB.1.raw
  modified_base (279)..(279): a, c, t, g, unknown or other
  misc_feature (279)..(279): n is a, c, g, or t
  modified_base (285)..(299): a, c, t, g, unknown or other
  misc_feature (285)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgcccctggtcactcctgttccccaccctcctcacatagtagtctgagcggggctgggcaaagggcncaatgnnnnnnnnnnnnnnn

SEQ ID NO: 264613 - DNA, 398 bp, Homo sapiens
  misc_feature: GYAE6OF02H3K7D.24.53.E09.1.454.CMB.1.raw
  modified_base (391)..(398): a, c, t, g, unknown or other
  misc_feature (391)..(398): n is a, c, g, or t
tcagactactatgtcacgaccggtgctcgatttagagagagtgtgttgggtttgggagcaacatcggcgcaggttttgatgtccactggtacaagcagcttccaaaaaacagcccccaaactcctcatttatcgtaacaacaatcggccctctggggtccctgaccgattctccgcctccaagtctggcacctcagcctcgctggccatcactgggctccaggctgaggatggagggtgattactacttgcccagtcgtcgaaagatggttcggcggaagggactaagctgaccgtcctaggtcaacgcccaaggctcgccccctcggcactctcgttccccacccctctcacatagtagtctgacggcgggctggacgaaggcacatagnnnnnnnn

SEQ ID NO: 264614 - DNA, 284 bp, Homo sapiens
  misc_feature: GYAE6OF02FWI8Q.24.53.E09.1.454.CMB.1.raw
  modified_base (280)..(284): a, c, t, g, unknown or other
  misc_feature (280)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnnn

SEQ ID NO: 264615 - DNA, 489 bp, Homo sapiens
  misc_feature: GYAE6OF02G2D5V.24.53.E09.1.454.CMB.1.raw
  modified_base (163)..(163): a, c, t, g, unknown or other
  misc_feature (163)..(163): n is a, c, g, or t
  modified_base (293)..(293): a, c, t, g, unknown or other
  misc_feature (293)..(293): n is a, c, g, or t
  modified_base (452)..(452): a, c, t, g, unknown or other
  misc_feature (452)..(452): n is a, c, g, or t
  modified_base (454)..(459): a, c, t, g, unknown or other
  misc_feature (454)..(459): n is a, c, g, or t
  modified_base (463)..(465): a, c, t, g, unknown or other
  misc_feature (463)..(465): n is a, c, g, or t
  modified_base (467)..(489): a, c, t, g, unknown or other
  misc_feature (467)..(489): n is a, c, g, or t
tcagactactatgtcacgaccggtgctcgatttagagagagtgtgttggggtttgggggctgtttttggaagctgcttgtaccagagggtcaccatctcctgcactgggagcaacatcggcgcaggttttgatgtccactggtacaagcagcttccaaaaacngccccccaaactccctcatttatcgtaacaacaatcggccctctggggtcccctgaccgattctccgcctccaagtctggcacctcagcctcgctggccatcactgggctccaggctgaggatgagggtnattactatgccagtcgtcgaagatgttcggcggagggactaagctgaccgtcctaggtcacgcccaaggcctcgcccccgtggtccactcctccgttcccccgccctccgtccacacgtagtacgtctggacgcgggctgggccgaaggccgcagtagntnnnnnngcgnnncnnnnnnnnnnnnnnnnnnnnnnn

SEQ ID NO: 264616 - DNA, 282 bp, Homo sapiens
  misc_feature: GYAE6OF02G81YA.24.53.E09.1.454.CMB.1.raw
  modified_base (282)..(282): a, c, t, g, unknown or other
  misc_feature (282)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagn

SEQ ID NO: 264617 - DNA, 447 bp, Homo sapiens
  misc_feature: GYAE6OF02F73SQ.24.53.E09.1.454.CMB.1.raw
  modified_base (161)..(161): a, c, t, g, unknown or other
  misc_feature (161)..(161): n is a, c, g, or t
  modified_base (224)..(224): a, c, t, g, unknown or other
  misc_feature (224)..(224): n is a, c, g, or t
  modified_base (399)..(399): a, c, t, g, unknown or other
  misc_feature (399)..(399): n is a, c, g, or t
  modified_base (433)..(447): a, c, t, g, unknown or other
  misc_feature (433)..(447): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattccnccgcctccaagtctggcacctcagcctcgctggccatcactgggctccaggctgaggatggagggtgattactactgccagtcgtcgaagatggttcggcggagggactaagctgaccgtctaggtcacgcccaaggctcgccccctggtcactctgttccccaccctcctcacntagtgtcctgcggcgggctggacgagcgcatcgnnnnnnnnnnnnnnn

SEQ ID NO: 264618 - DNA, 292 bp, Homo sapiens
  misc_feature: GYAE6OF02IIJBC.24.53.E09.1.454.CMB.1.raw
  modified_base (239)..(239): a, c, t, g, unknown or other
  misc_feature (239)..(239): n is a, c, g, or t
  modified_base (284)..(292): a, c, t, g, unknown or other
  misc_feature (284)..(292): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcacctctcgttcccnccctcctcacatagtgtctgaggcggctggacaaggcgacatagnnnnnnnnn

SEQ ID NO: 264619 - DNA, 354 bp, Homo sapiens
  misc_feature: GYAE6OF02IVG8P.24.53.E09.1.454.CMB.1.raw
  modified_base (343)..(354): a, c, t, g, unknown or other
  misc_feature (343)..(354): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgtattactactcgccagtcgtacgaagattggttcggcgggaggaactaagctcgacccgtcgtaggtcacgacccgaaggcctcccgccccccgttcggtccaccttccttccgttaccccccaccccttccctaccaactaagttaaggttacgtccgtaggacgggtccgggtcgtcggacgaacgggccgacagtagnnnnnnnnnnnn

SEQ ID NO: 264620 - DNA, 461 bp, Homo sapiens
  misc_feature: GYAE6OF02HGCA6.24.53.E09.1.454.CMB.1.raw
  modified_base (163)..(163): a, c, t, g, unknown or other
  misc_feature (163)..(163): n is a, c, g, or t
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
  modified_base (437)..(461): a, c, t, g, unknown or other
  misc_feature (437)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaatcctcatttatcgtaacaacaatcggccctntggggtccctgaccgattctccgcctccaagtctggcacctcagcctcgctggccatcactgggctccaggctgaggatgagggtnattactactgccagtcgcgaagntggtcggcggaggactaagctgaccgtctaggcacgcccgaagctcgcccctggtcactctcgtccccnccctcctcactatagtacgtctagacggcgggtctgggacaaggccgactatagnnnnnnnnnnnnnnnnnnnnnnnnn

SEQ ID NO: 264621 - DNA, 458 bp, Homo sapiens
  misc_feature: GYAE6OF02G4SB3.24.53.E09.1.454.CMB.1.raw
  modified_base (162)..(162): a, c, t, g, unknown or other
  misc_feature (162)..(162): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (440)..(440): a, c, t, g, unknown or other
  misc_feature (440)..(440): n is a, c, g, or t
  modified_base (442)..(458): a, c, t, g, unknown or other
  misc_feature (442)..(458): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtnattactactgccagtcgtcgaagntggttcggcggagggactaagctcgaccgtctaggtcagcccaaggctcgcccctgcactctcgttccccgccctcctcactatacgtacgtctggacggcgggctggcgaaagggccgactagtagnannnnnnnnnnnnnnnnn

SEQ ID NO: 264622 - DNA, 130 bp, Homo sapiens
  misc_feature: GYAE6OF02IJVYZ.24.53.E09.1.454.CMB.1.raw
  modified_base (129)..(130): a, c, t, g, unknown or other
  misc_feature (129)..(130): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctnn

SEQ ID NO: 264623 - DNA, 433 bp, Homo sapiens
  misc_feature: GYAE6OF02FQZUD.24.53.E09.1.454.CMB.1.raw
  modified_base (396)..(396): a, c, t, g, unknown or other
  misc_feature (396)..(396): n is a, c, g, or t
  modified_base (428)..(433): a, c, t, g, unknown or other
  misc_feature (428)..(433): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctcgttcccaccctcctcacntagtagtctgagcgggctggcaaggcgcatgnnnnnn

SEQ ID NO: 264624 - DNA, 611 bp, Homo sapiens
  misc_feature: GYAE6OF02JG965.24.53.E09.1.454.CMB.1.raw
  modified_base (237)..(237): a, c, t, g, unknown or other
  misc_feature (237)..(237): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(611): a, c, t, g, unknown or other
  misc_feature (587)..(611): n is a, c, g, or t
tcagactactatgtcacgaccggtgctcgatttagagagagtgtgttgggtttgggggtcgtgtttttggtaagtctgcttgtaccagagggtcaccatctcctgcactgggagcaacatcggcgcaggttttgatgtccactggtacaagcagcttccaaaaaacacgacccccaaactccctacattttatccgtaaacaacaatcggccctctcggggtccctgaccgattccnccgcctccaagtctggcacctcagcctcgctcggccatcactcggctccaggctggaggatggaggtgattacactgccagtcgtacggaagtattcgtcgggcgggaggactaaggcgtcggaaccgtccgtaggtccgaacggacccccgaaggtccgtaccgccccccgtttacgggtcccaaccgttcccgtttaccggttttcccccccaacccctttcccccgttaccaacccgttaacgttaccggtttaccgtttaacccgtggtaacccgggcccgggtacgttcggggaccaaacggggttcccggaccttaaggttaccgagngacnctagnncncngnnnnnnnnnnnnnnnnnnnnnnnnn

SEQ ID NO: 264625 - DNA, 162 bp, Homo sapiens
  misc_feature: GYAE6OF02I8BTW.24.53.E09.1.454.CMB.1.raw
tcagactactatgtcacgaccggtgctcgatttagagagagtgtgttgggtttgggggtgtggtggtctccactcccgcttgacgggctgctatctgcctcgctggccatcactgggctccaggctgaggatgagggtgattactactgccagtcgtcgaaa

SEQ ID NO: 264626 - DNA, 710 bp, Homo sapiens
  misc_feature: GYAE6OF02I11K6.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgtacttttggatgacctgggtccgccaggctccagggacggggctggagtgggtggccaatataaggcacgatggacgtagcatgtactatgtggactctgtgaagggccattcaccatctccagagaccaacgcccagaactcactgtatctggaaatcgaccagcctgagagtcgaggacacggctatgtattactgtgcgaccatactcagccaccgtggagtccgcaactctagaacttactttccgaagtcaagtttcgggggacccacgggggtccctaacccgttcgggtacccaccccggttccttccccttacgaccgtccctacccgaacccgaaccgggccccaacgttcccggttcccgtttccccccgtcgggccccgtcccccgtcggccccgttacccgagggtaccgacccgtaccccgttaccgggacgtaaccgcccgaaccggaccggcccggggtcccccggttcgggacccgttccgggtaccccgttacgggtaacccggtaaacgggtaccctttacccgtttacccgaaccgtaacgtttaaccgggttacgttacgtaaccgggg

SEQ ID NO: 264627 - DNA, 282 bp, Homo sapiens; identical to SEQ ID NO: 264547
  misc_feature: GYAE6OF02IE38C.24.53.E09.1.454.CMB.1.raw
  modified_base (280)..(282): a, c, t, g, unknown or other
  misc_feature (280)..(282): n is a, c, g, or t

SEQ ID NO: 264628 - DNA, 282 bp, Homo sapiens
  misc_feature: GYAE6OF02HLG5R.24.53.E09.1.454.CMB.1.raw
  modified_base (164)..(164): a, c, t, g, unknown or other
  misc_feature (164)..(164): n is a, c, g, or t
  modified_base (279)..(282): a, c, t, g, unknown or other
  misc_feature (279)..(282): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagntaagttcggcggagggactaagctgaccgtcctaggtcagcccaaggctcgccccctggtcactctgttccccgcctctcacatagtagtctgagcggctggcaaggcgcatagnnnn

SEQ ID NO: 264629 - DNA, 284 bp, Homo sapiens
  misc_feature: GYAE6OF02F6BKN.24.53.E09.1.454.CMB.1.raw
  modified_base (280)..(284): a, c, t, g, unknown or other
  misc_feature (280)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnnnnn

SEQ ID NO: 264630 - DNA, 282 bp, Homo sapiens; identical to SEQ ID NO: 263490
  misc_feature: GYAE6OF02GRCLL.24.53.E09.1.454.CMB.1.raw
  modified_base (280)..(282): a, c, t, g, unknown or other
  misc_feature (280)..(282): n is a, c, g, or t

SEQ ID NO: 264631 - DNA, 612 bp, Homo sapiens
  misc_feature: GYAE6OF02H1HCD.24.53.E09.1.454.CMB.1.raw
  modified_base (162)..(162): a, c, t, g, unknown or other
  misc_feature (162)..(162): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (577)..(580): a, c, t, g, unknown or other
  misc_feature (577)..(580): n is a, c, g, or t
  modified_base (582)..(583): a, c, t, g, unknown or other
  misc_feature (582)..(583): n is a, c, g, or t
  modified_base (585)..(587): a, c, t, g, unknown or other
  misc_feature (585)..(587): n is a, c, g, or t
  modified_base (590)..(597): a, c, t, g, unknown or other
  misc_feature (590)..(597): n is a, c, g, or t
  modified_base (599)..(612): a, c, t, g, unknown or other
  misc_feature (599)..(612): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacacaatcggccctctgggtccctgaccgattctccgcctccaagtctggcacctcagcctcgctggccatcactgggccttccaggctgaggatggagggtgatttactactgacccagttcgtacggaagagttcggttaccgggcgggtaacgggtactaaaggccgttacggaccccggttccgtaacgggtccaaccggaccccgaaagggtccgtaccgggtccccccgttacgggtaccctaaccgtttcccgttaccgtttccccccctaacccctttccctacctaacgtaccgtttaaacggttcggtccgttacgggaacgggtcccgggggtcttaacggggaccgaaacggggtcctacgaaacgttacggngncgnnnncnncnnngcnnnnnnnngnnnnnnnnnnnnnn

SEQ ID NO: 264632 - DNA, 576 bp, Homo sapiens
  misc_feature: GYAE6OF02IGLKB.24.53.E09.1.454.CMB.1.raw
  modified_base (411)..(411): a, c, t, g, unknown or other
  misc_feature (411)..(411): n is a, c, g, or t
tcagactactatgtcacgaccggtgctcgatttagagagagtgtgttgggtttggggaggcttggtccagcctggggggtccctgagactctcctgtgcagcctctggatttcccctttagtgtactttttggatgacctgggtccgccaggctccgagggacggggctggagtgggtggccaatataaggcacgatggacgtagcatgtactatgtgactctgtgaagggccattcaccatctcagagacaacgccagaactcactgtatctaggaaatgaccagcctgagagtcgagcacggctatgtattactgtgcgaccatatcagcaccgtggacgtcgcatcgtagtaattacttccgagtcagttcggggccagggcctacccgtgtccacccgtcctcctcncgcctaccaccgacggccctacgtccggttcccttcccccgtcggccgtccctcgccgtacccgaggacgccaccgtccgagaccgcacgacgccggcccgtcgggccgtcgccgtggtaccgaacggtaccttacctaccaacgtacttacgtacgtcgtacgg

SEQ ID NO: 264633 - DNA, 465 bp, Homo sapiens
  misc_feature: GYAE6OF02GAJIC.24.53.E09.1.454.CMB.1.raw
  modified_base (162)..(162): a, c, t, g, unknown or other
  misc_feature (162)..(162): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (444)..(465): a, c, t, g, unknown or other
  misc_feature (444)..(465): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngaccccccaaactcctcatttatcgtaaacaacaatcggccctctggggtccctgaccgattctcccgcctccaagtctggcacctcagcctcgctggccatcactgggctccgagctgaggatgagggtgattactactgccaggtcgtcgaagatggttcggcggagggactaagctggaccgtcctaggtcaacgcccaaggctcgccccctggtccactctcgtccccnccctcctcactntacgtgtctggacgcgggctggcgaacggcgcagtgnnnnnnnnnnnnnnnnnnnnnn

SEQ ID NO: 264634 - DNA, 457 bp, Homo sapiens
  misc_feature: GYAE6OF02FKHVU.24.53.E09.1.454.CMB.1.raw
  modified_base (443)..(457): a, c, t, g, unknown or other
  misc_feature (443)..(457): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgaggggtgattactactgccagtcgtcgaagatgttcggcgggagggactaaggctgaccgtcctaggtcagcccaagggcctgccccctggtcactctcgttccccaccctcctcacatacgtagtctggaggccgggctgggcaacgggcgcagtagnnnnnnnnnnnnnnn

SEQ ID NO: 264635 - DNA, 551 bp, Homo sapiens
  misc_feature: GYAE6OF02JXFA8.24.53.E09.1.454.CMB.1.raw
  modified_base (163)..(163): a, c, t, g, unknown or other
  misc_feature (163)..(163): n is a, c, g, or t
  modified_base (522)..(551): a, c, t, g, unknown or other
  misc_feature (522)..(551): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaaacaacaatccggccctcgtcggggtcccctgaccgattcctccgcctccaagttctggccacctcacgcctcgctcggccatccacgtggctccaggtctgaggatggagggttattactagtcgccaggtcgtacgaagtacttcgggtcggacgggaaggtactaagcgtacgacccgttcgtaggtcacgtacccgaaggtcctacccggcccccgttggacctaccgttccttccggttccccccacccgtttcccgacaaccgtagttacgtacgtcgtacggacgggccgggtactcgggaccgtaacggcccgtaactagtagcnnnnnnnnnnnnnnnnnnnnnnnnnnnnnn

SEQ ID NO: 264636 - DNA, 627 bp, Homo sapiens
  misc_feature: GYAE6OF02GOAC9.24.53.E09.1.454.CMB.1.raw
  modified_base (221)..(221): a, c, t, g, unknown or other
  misc_feature (221)..(221): n is a, c, g, or t
  modified_base (319)..(319): a, c, t, g, unknown or other
  misc_feature (319)..(319): n is a, c, g, or t
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccgagggacggggctggagtgggtggccaatataaggcacgatggacgtagcatgtactatgtggactntgtgaagggccattcaccatctccagagacaacgcccagaactcactgtatctggaaatcgaccagcctgagagtcgaggacacggctatgtattacnggtgcgaccgatatcagcaccgtggagtcgcatctagaatacttccgagctagttcggggcccgacggggcctacccgtcggtcctacccgttcctccgtccacgccctacccacccgaacggcccacgttccggtcccttccccgtcggcccgtcccgtcgccctaccgacggaccgtccgaccgttcccggacgacgcccgaacgaccggcccgggtcccgtcggggtcctcggtcccggttacgggtaccgtaacgggtacccttaccgttcccgaacgttaacgtacgttacggtccgtacggg

SEQ ID NO: 264637 - DNA, 465 bp, Homo sapiens
  misc_feature: GYAE6OF02GJ2XQ.24.53.E09.1.454.CMB.1.raw
  modified_base (160)..(160): a, c, t, g, unknown or other
  misc_feature (160)..(160): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
  modified_base (429)..(431): a, c, t, g, unknown or other
  misc_feature (429)..(431): n is a, c, g, or t
  modified_base (433)..(457): a, c, t, g, unknown or other
  misc_feature (433)..(457): n is a, c, g, or t
  modified_base (459)..(465): a, c, t, g, unknown or other
  misc_feature (459)..(465): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgacccgattctccgcctccaagtctggcacctcagcctcgactggccatccactgggctccaggctgaggatgagggtnattactaactgcccagtcgtcgaagatgttcggnggaggactaagctgaccgtctaggtcagcccaaggctgcccctggcacgtctgttcccgccctcctcacatacgtagtctgagcgggctggcaaggcncattacgnnngnnnnnnnnnnnnnnnnnnnnnnnnncnnnnnnn

SEQ ID NO: 264638 - DNA, 444 bp, Homo sapiens
  misc_feature: GYAE6OF02HBZ2B.24.53.E09.1.454.CMB.1.raw
  modified_base (162)..(162): a, c, t, g, unknown or other
  misc_feature (162)..(162): n is a, c, g, or t
  modified_base (428)..(444): a, c, t, g, unknown or other
  misc_feature (428)..(444): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgcccctggtcactctgttccccaccctcctcacatagtacgtctgagcgggctggcaaggcgcatagnnnnnnnnnnnnnnnnn

SEQ ID NO: 264639 - DNA, 461 bp, Homo sapiens
  misc_feature: GYAE6OF02GS3XP.24.53.E09.1.454.CMB.1.raw
  modified_base (162)..(162): a, c, t, g, unknown or other
  misc_feature (162)..(162): n is a, c, g, or t
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
  modified_base (448)..(449): a, c, t, g, unknown or other
  misc_feature (448)..(449): n is a, c, g, or t
  modified_base (451)..(461): a, c, t, g, unknown or other
  misc_feature (451)..(461): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactggctccaggctgagatgaggtgattactactgccagtcgtacgaagatgttcggcggagggactaagntcgaccgtcctaggtcaacgccccaaggcctccgcccccgtggccactcttacgtcccacccttccnccacctatacgtacgtcgtgacggcgggtctgggcaacggcagataggnncnnnnnnnnnnn

SEQ ID NO: 264640 - DNA, 548 bp, Homo sapiens
  misc_feature: GYAE6OF02H303U.24.53.E09.1.454.CMB.1.raw
  modified_base (522)..(524): a, c, t, g, unknown or other
  misc_feature (522)..(524): n is a, c, g, or t
  modified_base (526)..(548): a, c, t, g, unknown or other
  misc_feature (526)..(548): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaaactcctcatttatcgtaaacaacaatcggccctcgtggggtcccctgaccgattctccgcctccaagtctggcacctcagccctcgctggccatcacgtgggcctccacggctggaggatggagggtgattactactgcccagtcgtcgaagattgttcggcggagggactaagctggaccgtcgtaggtcacgacccaagggcctcgccccccgttcggtacctaccgtcccgttcgtttccccccggaccccttcccctacctaacgtaacgtttaacggttaacgttcctacgggtaacgggccgggggtaccgtcgggaccgaaacggggccaccgaattacggnnngnnnnnnnnnnnnnnnnnnnnnnn

SEQ ID NO: 264641 - DNA, 679 bp, Homo sapiens
  misc_feature: GYAE6OF02FFNNZ.24.53.E09.1.454.CMB.1.raw
  modified_base (150)..(150): a, c, t, g, unknown or other
  misc_feature (150)..(150): n is a, c, g, or t
  modified_base (338)..(338): a, c, t, g, unknown or other
  misc_feature (338)..(338): n is a, c, g, or t
tcagactactatgtcacgaccggtgctcgatttagagagagtgtgttgggtttggggaggcttggtccagcctggggggtccctgagactctcctgtgcagcctctggacttcccctttagtgtactttttggatcgaccgtgggtcccnccaggctccgaggggacgggctggagtgggtgccaatataaggcacgatggactagcatgtactatgtggactctgtgaacggcctattcacctatcctaccagacgaccaaccggcccagtaacctcaactgtatcgtaggaaatcgaccagcctagagagtcgagacacggtctagtgtattacgngtcgacgaaccatactcaacggtctaccgtggacgtcgactatctagaacttccttccgagtcctaacgggttcggggacccacgggtcccacccggtcggtaccacccgttcctaccctccacgccctacccgaaccgaaccggccctagttcccggtcccctttcccgcggccctcccgtcgtccctaccgacgggtaccacccgacccgttacgacgacgaccgtaccgacggcccgtaccggtcggtcccgtacggtcccggttaccgtaacggttaaccggaaccctttaacccgttaccgtaacctacggttaacggttaccgttcggtaccggg

SEQ ID NO: 264642 - DNA, 315 bp, Homo sapiens
  misc_feature: GYAE6OF02FMWLV.24.53.E09.1.454.CMB.1.raw
  modified_base (279)..(279): a, c, t, g, unknown or other
  misc_feature (279)..(279): n is a, c, g, or t
  modified_base (294)..(315): a, c, t, g, unknown or other
  misc_feature (294)..(315): n is a, c, g, or t
tcagactactatgtcacgaccggtgctcgatttagagagagtgtgtttgggtttggggggtgtggtggtctccactcccgccttgacggggctgctatctgcctcgctggccatcactgggctccaggctgagggatgagggtgattactactgccagtcgtcgaagactgttcggcggagggactaagctgaccgtctaggtcagcccaaggctcgccccctggtcactctcgttccccgccctcctcacatagtagtctggacggcgggtctcgggnaagggtcgcataggnnnnnnnnnnnnnnnnnnnnnn

SEQ ID NO: 264643 - DNA, 663 bp, Homo sapiens
  misc_feature: GYAE6OF02F01JE.24.53.E09.1.454.CMB.1.raw
  modified_base (190)..(190): a, c, t, g, unknown or other
  misc_feature (190)..(190): n is a, c, g, or t
  modified_base (294)..(294): a, c, t, g, unknown or other
  misc_feature (294)..(294): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
tcagactactatgtcacgaccggtgctcgatttagagagagtgtggttggggtttgggggctgttttggaagctgcttgtaccagagggttcaccagtctcctgcactgggagcaaacgatcggcgcaggttttgatggtccactgggtacaaggtccagtccttaaccaaaactcgacccctaactccnctattactacgtaaacaaactagtcggcccgtcgggtcgggtccctggaccgtattcctccgcctacacgtcgtggcctacctcacgtcctcgctcggacctancgtacgtgggcctccgacggcctaggaggtctaggtagggtacgtacttaacgtcgtcgaccgtaggtcggtacgaagtagttcggggttcggacgggtaacgtaacgtaaaggtccgtacgtacccgttacgtaacggttccaccggtaaccgtaagggtcctcccggtccccgtttcggtacggaccgttccgttaccgttccccctaacccgtccgtaaccaacgtaacgtaacggttaaccgtacttcgggaacggtccgggtactacgggaaccgtaacgggcctacgtaagttagnactgctancncngcncacnctatntntnncancncgcgcgcgcgcgtcgcgacgcgctcnctcncnc

SEQ ID NO: 264644 - DNA, 479 bp, Homo sapiens
  misc_feature: GYAE6OF02JEHOM.24.53.E09.1.454.CMB.1.raw
  modified_base (162)..(162): a, c, t, g, unknown or other
  misc_feature (162)..(162): n is a, c, g, or t
  modified_base (452)..(479): a, c, t, g, unknown or other
  misc_feature (452)..(479): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngccccccaaactcctcatttatcgtaacaacaatcggccctctggggtccctgaccgattcctccgcctccaagtctggcacctcagcctcgctggccatcactggctccaggctgaggatgagggtgattactactgccagtcgtacgaagatgtcggcggtaggactaagctgaccgtctaggtcagcccaaggctcgcccctggccacttcctcgtttcccccgcccttacccgtcactacttagtacgtccgtgacggccgggtactgggcgaaggcgcagtagcnnnnnnnnnnnnnnnnnnnnnnnnnnnn

SEQ ID NO: 264645 - DNA, 299 bp, Homo sapiens
  misc_feature: GYAE6OF02IP626.24.53.E09.1.454.CMB.1.raw
  modified_base (283)..(299): a, c, t, g, unknown or other
  misc_feature (283)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttccccaccctcctcacatagtagtctgagcgggctggccaaggcgcaatgnnnnnnnnnnnnnnnnn

SEQ ID NO: 264646 - DNA, 285 bp, Homo sapiens
  misc_feature: GYAE6OF02HVXDN.24.53.E09.1.454.CMB.1.raw
  modified_base (281)..(285): a, c, t, g, unknown or other
  misc_feature (281)..(285): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnnn

SEQ ID NO: 264647 - DNA, 283 bp, Homo sapiens
  misc_feature: GYAE6OF02GEZBT.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggtggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccaccctcctcacatagtagtctgagcgggctggcaaggcgcatagnnn

SEQ ID NO: 264648 - DNA, 287 bp, Homo sapiens
  misc_feature: GYAE6OF02IYXZF.24.53.E09.1.454.CMB.1.raw
  modified_base (282)..(287): a, c, t, g, unknown or other
  misc_feature (282)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttcccaccctcctcacatagtagtctgagcgggctggcaaggcgacatagnnnnnn

SEQ ID NO: 264649 - DNA, 163 bp, Homo sapiens
  misc_feature: GYAE6OF02HWJ6G.24.53.E09.1.454.CMB.1.raw
  modified_base (160)..(163): a, c, t, g, unknown or other
  misc_feature (160)..(163): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaannnn

SEQ ID NO: 264650 - DNA, 440 bp, Homo sapiens
  misc_feature: GYAE6OF02HNAXV.24.53.E09.1.454.CMB.1.raw
  modified_base (161)..(161): a, c, t, g, unknown or other
  misc_feature (161)..(161): n is a, c, g, or t
  modified_base (410)..(410): a, c, t, g, unknown or other
  misc_feature (410)..(410): n is a, c, g, or t
  modified_base (426)..(440): a, c, t, g, unknown or other
  misc_feature (426)..(440): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatgagggtgattacactgccagtcgtcgaagatgttcggcggagggactaagctgaccgtctaggtcagcccaaggctcgccccctggtcactctcgttccccgcctcctcacatagtagtctgagcgggntggcaggcgcagtagnnnnnnnnnnnnnnn

SEQ ID NO: 264651 - DNA, 429 bp, Homo sapiens
  misc_feature: GYAE6OF02GAZL2.24.53.E09.1.454.CMB.1.raw
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
  modified_base (425)..(429): a, c, t, g, unknown or other
  misc_feature (425)..(429): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctgggtccctgaccgattctccgcctccaagtctggcacctcagcctcgctggccatcactgggctccagctgaggatgagggtgattactactgccagtcgtcgaagatgtcggcggagggactaagctgaccgtctaggtcagcccaaggctcgccccctggtcactctcgttcccnccctcctcacatagtagtctgagcgggtctggcaggcgcntagnnnnn

SEQ ID NO: 264652 - DNA, 305 bp, Homo sapiens
  misc_feature: GYAE6OF02GOZJ1.24.53.E09.1.454.CMB.1.raw
  modified_base (302)..(305): a, c, t, g, unknown or other
  misc_feature (302)..(305): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattattactgtgcagcatgggatgccagtctgagtggtacgctgttcggcggagggaccaagctgaccgtcctaggtcagcccaaggctcgccccctcggtcactctcgttccccgccctcctcacatagtagtctgagcgggctggcaaggcgcatagnnnn

SEQ ID NO: 264653 - DNA, 284 bp, Homo sapiens
  misc_feature: GYAE6OF02IGLV6.24.53.E09.1.454.CMB.1.raw
  modified_base (282)..(284): a, c, t, g, unknown or other
  misc_feature (282)..(284): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttcccgccctcctcacatagtagtctgagcgggctggcaaggcgcatagnnn

SEQ ID NO: 264654 - DNA, 285 bp, Homo sapiens
  misc_feature: GYAE6OF02GVI9W.24.53.E09.1.454.CMB.1.raw
  modified_base (281)..(285): a, c, t, g, unknown or other
  misc_feature (281)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccaccctcctcacatagtagtctgagcgggctggcaaggcgcatagnnnnn

SEQ ID NO: 264655 - DNA, 282 bp, Homo sapiens
  misc_feature: GYAE6OF02G561E.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttcccccctctcacatagtagtctgagcgggctggcaaggcgcatagnnnnn

SEQ ID NO: 264656 - DNA, 762 bp, Homo sapiens
  misc_feature: GYAE6OF02G2D1X.24.53.E09.1.454.CMB.1.raw
  modified_base (148)..(148): a, c, t, g, unknown or other
  misc_feature (148)..(148): n is a, c, g, or t
tcagactactatgtcacgaccggtgctcgatttagagagagtgtgttgggtttgggaggcttgggtccagcctggggggtccctgagacctctccctgtgcagcctctggatttcccctttagtgactttttggatgacctgggtccnccaggctccagggacgggctggagtgggtgccaatataaggctacgtagtggtaacgttagcatgtactatgtggactcgtggtaggaagggccgtagttcacctatcctaccgagagaccaaccgcccaagaacctcactgtatcgagaatcgacagcctgacgagtcgaggacacggctatgttattacgtggtcgacaacctatacgtcgaaggcctaccgtggacgtccgactacgttcgtaagtaacttacttaccgagtacgtaggttacggggacctagggaccctacccggtcggtacccgtacccgttccgtacccgtacgtacccgtacccgttacccgaacccgtaacccgggtacccctacgttaccccggttaccccgtttaccccccggacgggtccccgtacccctaccggtaccccgttacccggtaacggtacccgtacccgtaacccggtaccggaaacgaccgtaccgaaccggacccggtcccgggtacccgtcggggtcccgttaccggggacccgttacgggtaacccgtaacggttacccttaccgttacccgtaacgttaacgtttaaccggttacgttcggtaaccggg

SEQ ID NO: 264657 - DNA, 578 bp, Homo sapiens
  misc_feature: GYAE6OF02HK8P5.24.53.E09.1.454.CMB.1.raw
  modified_base (317)..(317): a, c, t, g, unknown or other
  misc_feature (317)..(317): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaagggccattccaccatctccagagacaacgcccagaactcactgtatctaggaaatgaccagcctgagagtcgaggacacggctatgtattacngtgcgaccatatcagcaccgtggactcgcatctgaaacttacttccagtctaagttcgggggaccaggggcctacccgtggtcccaccgttcctccctacacgccctaccgaaccgaacgggcccaagttcccggtacccttccccgtcggcccgcccctcgcctccgacggaccgcacccgtccgacgacgccacgacgccggcccgtggcctcggcctcggtacaacggacttactccatacgtacgtacgtcgtacgg

SEQ ID NO: 264658 - DNA, 605 bp, Homo sapiens
  misc_feature: GYAE6OF02IV8Q4.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacgggctagtgtattactgtgcgaccattatcagcacctggagtcgcatctgaattacttccagctagttggggacccagggccacccgtcgggtccacccggtctccctcacgtccctacccaaccgaaccgggcccctagttcccggttccctttcccccgtcgggcccgtccccgtcgccctacccgagggacgcccaccgtccgacgacgccaacgacgccggcccgtcgggccgtcggcccttcgggtacctaacggtaccttacccgtttccgaacgtacgtacggttacgtcgtacgg

SEQ ID NO: 264659 - DNA, 432 bp, Homo sapiens
  misc_feature: GYAE6OF02HLYWT.24.53.E09.1.454.CMB.1.raw
  modified_base (427)..(432): a, c, t, g, unknown or other
  misc_feature (427)..(432): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaatcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtctaggtcagcccaaggctgcccctggtcactctcgttcccaccctcctcacatacgtagtctgacgcgggctggcaaggcgcatagnnnnnn

SEQ ID NO: 264660 - DNA, 487 bp, Homo sapiens
  misc_feature: GYAE6OF02HCQ00.24.53.E09.1.454.CMB.1.raw
  modified_base (162)..(162): a, c, t, g, unknown or other
  misc_feature (162)..(162): n is a, c, g, or t
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(487): a, c, t, g, unknown or other
  misc_feature (462)..(487): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaaacaacaatcggccctctggggtccctgaccgattctccgcctcaagtctggcacctcagcctgctggccatcactggctccaggctgagatggaggtnattactactgccagtcgtcgaagntgttcggcggaggactaagctgaccgtcctaggtcagacccaaggcctcgccccctggtcactcgtcttccccaccctcctcacatagtacgtctagacgcgggctcgggacgaaacgggtccgacgtaagttacgntnntagcnngngcngnnnnnnnnnnnnnnnnnnnnnnnnnn

SEQ ID NO: 264661 - DNA, 434 bp, Homo sapiens
  misc_feature: GYAE6OF02HEZ9L.24.53.E09.1.454.CMB.1.raw
  modified_base (162)..(162): a, c, t, g, unknown or other
  misc_feature (162)..(162): n is a, c, g, or t
  modified_base (426)..(434): a, c, t, g, unknown or other
  misc_feature (426)..(434): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgagatgaggtgattactactgcctagtcgtcgaagatgttcggcggagggactaagctgaccgtctaggtcagccaaggctcgccccctggtcactctcgttccccgcctcctcacatagtagtctgagcgggctggctaaggcgcatagnnnnnnnnn

SEQ ID NO: 264662 - DNA, 475 bp, Homo sapiens
  misc_feature: GYAE6OF02HJLUQ.24.53.E09.1.454.CMB.1.raw
  modified_base (162)..(162): a, c, t, g, unknown or other
  misc_feature (162)..(162): n is a, c, g, or t
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (451)..(451): a, c, t, g, unknown or other
  misc_feature (451)..(451): n is a, c, g, or t
  modified_base (459)..(475): a, c, t, g, unknown or other
  misc_feature (459)..(475): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctcgtggggtccctgaccgattccnccgcctccaagtctggccacctcagccctcgctggccatcactgggcctccgaggctggagatggagggtnattacactgcccaggtcgtacgaagatggttcggcggagggactaaggctagacccgttcgtaggtcacgcccaagggcctaccggccccctggtcacttctccgtccccgccctcctcactatagtagtctgagcgggctgggacaacgggcncagtacgnnnnnnnnnnnnnnnnn

SEQ ID NO: 264663 - DNA, 479 bp, Homo sapiens
  misc_feature: GYAE6OF02H2WTD.24.53.E09.1.454.CMB.1.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (448)..(479): a, c, t, g, unknown or other
  misc_feature (448)..(479): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagcttccaaaaaacacgcccccaaaactcctcatttatcgtaaacaacaatccggccctcgtggggtccctgaccgattcnccgcctccaagtctggccacctcacgcctcgctggccatcacgtgggcctccaggctggagatggaggtnattacacgtgccagtcgagaagntgtcggcggaaggactaagctcgaccgtccgtagtcacgcccaaggctcgcccctgcactctcgtccccaccctcacacatagtacgtctgacggcgggtctggacgaacgggcgacaatagcannnnnnnnnnnnnnnnnnnnnnnnnnnnnnnn

SEQ ID NO: 264664 - DNA, 628 bp, Homo sapiens
  misc_feature: GYAE6OF02G04O0.24.53.E09.1.454.CMB.1.raw
  modified_base (589)..(590): a, c, t, g, unknown or other
  misc_feature (589)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
  modified_base (604)..(608): a, c, t, g, unknown or other
  misc_feature (604)..(608): n is a, c, g, or t
  modified_base (610)..(613): a, c, t, g, unknown or other
  misc_feature (610)..(613): n is a, c, g, or t
  modified_base (615)..(625): a, c, t, g, unknown or other
  misc_feature (615)..(625): n is a, c, g, or t
  modified_base (627)..(628): a, c, t, g, unknown or other
  misc_feature (627)..(628): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgcccccaaactcctcattttatcgtaaacaacaatccggccctcgtcggggtccctgaccgattcctccgcctccaagtctggccacctcacgcctcgctcggccatccacgtcgggcctccgaggtctggagggattggagggttgtaactttacctacgtcgacccgtaggtccgtacggaaggtagttcgggttcgggaccgggagggtaacgtaacgtcgtacggtacccgttccgtacgggtaccacgaccccgaacggtccgtacccggtcccccggttcggtacctaccgtttccgttacccgttcccccaacccctttccacctaccgtaacgtttacggttacgtcgtacgggaccggccggggtaccgtcggggaaccgaacggggtcccggaaacgtaacggttagcgacgcgnncngngcncnngcgnnnnngnnnngnnnnnnnnnnncnn

SEQ ID NO: 264665 - DNA, 439 bp, Homo sapiens
  misc_feature: GYAE6OF02G9SUM.24.53.E09.1.454.CMB.1.raw
  modified_base (162)..(162): a, c, t, g, unknown or other
  misc_feature (162)..(162): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (430)..(439): a, c, t, g, unknown or other
  misc_feature (430)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattctccgcctccaagtctggcacctcagcctcgctggccatcactgggctccaggctgaggntggagggtgattactactgccagtcgtcgaagntggttcggcggaggactaagctgaccgtctaggtcagcccaggctcgcccctggcactctcgttccccgcctcctcactatagtacgtctgacgcgggtctggcaaggcgcagtgnnnnnnnnnn

SEQ ID NO: 264666 - DNA, 623 bp, Homo sapiens
  misc_feature: GYAE6OF02HBS1C.24.53.E09.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (507)..(507): a, c, t, g, unknown or other
  misc_feature (507)..(507): n is a, c, g, or t
tcagactactatgtcacgaccggtgctcgattttagagagagtgtgttggggtttggggggtagtggtggtcctaccgactcccgccttgacgggctgctatctgtcctgctggccatcactggctcagctgaggatgagggtgacttacgtactgcctagtcgtcgaaagtattggttccggcggacgggactaagccttggaccgtcctaaggtcaagtcccaaagggctcgccccctggtacactcgtcgttccccgccctctacacagtagtactctgagcgggntggacaaaggcgtcaatcgntagnacagtcncgngacncttcgngacncgacgagtacgntcgacgttcgagtgcgtacagtacatnagtcagcagcagacctggactacgtacttcgacaacgtanacaagcgtaaacnccggtataacgggtcttacggaagttccgaaagtttccaaaaggtctagtaccttaaggcctaagggtctttaaacgnggtacccctaggtaactgtaacccgtttgggaaccctagttaacccggtaaacggtcgtaacgtcggttaaccgaaccgttaacggtcgttacaccggttacgtaccgagtcccgg

SEQ ID NO: 264667 - DNA, 441 bp, Homo sapiens
  misc_feature: GYAE6OF02GZXVJ.24.53.E09.1.454.CMB.1.raw
  modified_base (421)..(421): a, c, t, g, unknown or other
  misc_feature (421)..(421): n is a, c, g, or t
  modified_base (427)..(441): a, c, t, g, unknown or other
  misc_feature (427)..(441): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgtcggcggagggactaagctgaccgtctaggtcagcccaaggcctgccccctggtcactctcgtccccaccctcctcacatagtagtctgagcgggctggcaaggcncatagnnnnnnnnnnnnnnn

SEQ ID NO: 264668 - DNA, 392 bp, Homo sapiens
  misc_feature: GYAE6OF02HN21Z.24.53.E09.1.454.CMB.1.raw
  modified_base (373)..(373): a, c, t, g, unknown or other
  misc_feature (373)..(373): n is a, c, g, or t
  modified_base (378)..(392): a, c, t, g, unknown or other
  misc_feature (378)..(392): n is a, c, g, or t
tcagactactatgtcacgaccggtgctcgatttagagagagtgtgttgggtttgggagcaacatcggcgcaggttttgatgtccactggtacaagcagcttccaaaaaacagcccccaaactcctcatttatcgtaacaacaatcggccctctggggtccctgaccgattctccgcctccaagtctggcacctcagcctcgctggccatcactgggctccaggctgaggatgagggtgattacactgccagtcgtcgaagatgttcggcggagggactaagctgaccgtcctaggtcagcccaaggctcgccccctcggtcactctcgtcccacctcctcacatagtagtctgagcgggctggacaaggcganatagnnnnnnnnnnnnnnn

SEQ ID NO: 264669 - DNA, 445 bp, Homo sapiens
  misc_feature: GYAE6OF02FL01Y.24.53.E09.1.454.CMB.1.raw
  modified_base (162)..(162): a, c, t, g, unknown or other
  misc_feature (162)..(162): n is a, c, g, or t
  modified_base (286)..(286): a, c, t, g, unknown or other
  misc_feature (286)..(286): n is a, c, g, or t
  modified_base (431)..(445): a, c, t, g, unknown or other
  misc_feature (431)..(445): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctgagatgaggtnattacactgccagtcgtgaagatgttcggcggagggactaagctggacctctaggtcagcccaaggctcgccccctggtcactctcgttccccgccctcctcactactagtagtctgacggcgggctcgggcaaggcgacatagnnnnnnnnnnnnnnn

SEQ ID NO: 264670 - DNA, 280 bp, Homo sapiens
  misc_feature: GYAE6OF02HFJQ2.24.53.E09.1.454.CMB.1.raw
  modified_base (278)..(280): a, c, t, g, unknown or other
  misc_feature (278)..(280): n is a, c, g, or t
tcagactactatgtcacgaccggtgctcgatttagagagagtgtgttgggtttgggggtgtggtggtctccactcccgccttgacggggctgctatctacctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcggctggcaaggcgcatagnnn

SEQ ID NO: 264671 - DNA, 446 bp, Homo sapiens
  misc_feature: GYAE6OF02JCHP3.24.53.E09.1.454.CMB.1.raw
  modified_base (162)..(162): a, c, t, g, unknown or other
  misc_feature (162)..(162): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (393)..(393): a, c, t, g, unknown or other
  misc_feature (393)..(393): n is a, c, g, or t
  modified_base (432)..(446): a, c, t, g, unknown or other
  misc_feature (432)..(446): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaaactcctcatttatcgtaacaacaatcggccctctggggtccctgaccgattctccgcctccaagtctggcacctcagcctcgctggcccatcacgtgggctccaggctgaggntggagggtnattactactgccagtcgtcgaagntgttcggcggagggactaagctgaccgtctaggtcacgcccaagctcgccccctgtcactctcgttcccaccctcncacatagtatcgtgacggcggctggcaaggcgacatagnnnnnnnnnnnnnnn

SEQ ID NO: 264672 - DNA, 283 bp, Homo sapiens; identical to SEQ ID NO: 263736
  misc_feature: GYAE6OF02G3GYV.24.53.E09.1.454.CMB.1.raw
  modified_base (281)..(283): a, c, t, g, unknown or other
  misc_feature (281)..(283): n is a, c, g, or t

SEQ ID NO: 264673 - DNA, 598 bp, Homo sapiens
  misc_feature: GYAE6OF02F4BLA.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctagaatacttccagctagttcggggccagggccacccgtcggtcacccgtctccctcacgccctcccacccgaacggccccacgtaccggtcccttcccccgtcggcccgtcccctcgcctccgacggtacgccgacccgtaccgacgacgccgaaccgacgcccggcccgtcgggcctcggcccgttcgggtaccgaacgggtacccttaaccgttcccaacgtacgttacggttacggttcctacggg

SEQ ID NO: 264674 - DNA, 283 bp, Homo sapiens
  misc_feature: GYAE6OF02GFN54.24.53.E09.1.454.CMB.1.raw
  modified_base (281)..(283): a, c, t, g, unknown or other
  misc_feature (281)..(283): n is a, c, g, or t
tcagactactatgtcacgaccggtgctcgatttagagagagtgtgttgggtttgggggtgtggtggtctccactcccgccttgacggggctgctatctgcctcgctggccatcactggctccaggctgaggatgagggtgattactactgccagtcgtcgaagatgttcggcggagggactaagctgaccgtcctaggtcagcccaaggctgccccctcggtcactctcgttccccaccctcctcacatagtagtctgagcgggctggcaaggcgcatagnnn

SEQ ID NO: 264675 - DNA, 557 bp, Homo sapiens
  misc_feature: GYAE6OF02JR4OK.24.53.E09.1.454.CMB.1.raw
  modified_base (500)..(500): a, c, t, g, unknown or other
  misc_feature (500)..(500): n is a, c, g, or t
  modified_base (525)..(526): a, c, t, g, unknown or other
  misc_feature (525)..(526): n is a, c, g, or t
  modified_base (530)..(533): a, c, t, g, unknown or other
  misc_feature (530)..(533): n is a, c, g, or t
  modified_base (535)..(538): a, c, t, g, unknown or other
  misc_feature (535)..(538): n is a, c, g, or t
  modified_base (540)..(557): a, c, t, g, unknown or other
  misc_feature (540)..(557): n is a, c, g, or t
tcagactactatgtcacgaccggtgctcgatttagagagagtgtgttgggtttgggggtcgtgttttggtagctgcttgtacagagggtcaccatctcctgcactgggagcaacatcggcgcaggttttgatgtccactggtacaagcagcttaccaaaaacacgaccccccaaactccctcatttactcgtaacaacaatcgccctctggggtccctgaccgattcctccgctccaagtctggccacctcacgcctcgctcggaccatccactgggcctccgacgcctggaggactggagggtgattactacgtcgcctacgcgttacgaagacgttggttacggcgggaacgggactaacggctcggaccgttccgttagggccaacgccccgaagggtctaccggacccccctgggtacccaacctttccgaccggttttcccctacccggtccctacgaccctagttaccgtagttcctaggacggccgggttacncgggacgacggtccgactagtacgnncgannnncnnnncnnnnnnnnnnnnnnnnnn

SEQ ID NO: 264676 - DNA, 434 bp, Homo sapiens
  misc_feature: GYAE6OF02J2CMK.24.53.E09.1.454.CMB.1.raw
  modified_base (333)..(333): a, c, t, g, unknown or other
  misc_feature (333)..(333): n is a, c, g, or t
  modified_base (383)..(385): a, c, t, g, unknown or other
  misc_feature (383)..(385): n is a, c, g, or t
  modified_base (387)..(387): a, c, t, g, unknown or other
  misc_feature (387)..(387): n is a, c, g, or t
  modified_base (391)..(434): a, c, t, g, unknown or other
  misc_feature (391)..(434): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgaggtgattactactgccagtcgtacgaagatgttcggcggaagggactaagctgaccgtctaggtcagcccaaggctgccccctggtcactctcgttccccncctcctcactatagtagtctagcgccgggctcgggctaaggcgcatacgnnngntgcnnnnnnnnnnnnnnnnnnnnnnnnnnnnnnnnnnnnnnnnnnnn

SEQ ID NO: 264677 - DNA, 463 bp, Homo sapiens
  misc_feature: GYAE6OF02F1YIZ.24.53.E09.1.454.CMB.1.raw
  modified_base (162)..(162): a, c, t, g, unknown or other
  misc_feature (162)..(162): n is a, c, g, or t
  modified_base (183)..(183): a, c, t, g, unknown or other
  misc_feature (183)..(183): n is a, c, g, or t
  modified_base (314)..(314): a, c, t, g, unknown or other
  misc_feature (314)..(314): n is a, c, g, or t
  modified_base (409)..(409): a, c, t, g, unknown or other
  misc_feature (409)..(409): n is a, c, g, or t
  modified_base (436)..(463): a, c, t, g, unknown or other
  misc_feature (436)..(463): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaatcctcatttancgtaaacaacaatccggccctctggggtccctgaccgattctccgcctccaagtctggcacctcagcctcgctggccatccactgggctccaggctgaggatgaggtgattacactgccagtcgtcgaagntggttcggcggagggactaagctgaccgtcctaggtcacgcccaaggctcgccccctggtcactctgttccccaccctcctcacatacgtagtcngacgcgggctggacaaggccacatagnnnnnnnnnnnnnnnnnnnnnnnnnnnn

SEQ ID NO: 264678 - DNA, 551 bp, Homo sapiens
  misc_feature: GYAE6OF02HFXZF.24.53.E09.1.454.CMB.1.raw
  modified_base (188)..(188): a, c, t, g, unknown or other
  misc_feature (188)..(188): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (469)..(469): a, c, t, g, unknown or other
  misc_feature (469)..(469): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagactactatgtcacgaccggtgctcgatttagagagagtgtggttgggtttgggggcgtgttttggtaagctgcttgtaccagagggtcaccatctctgcactgggagcaacagtcggcgcaggttttcgagtgtccactggtacaagcgagcttaccaaaaacgtcccccaaatcctcatttancgtaacaacaatcggccctgtggggtccctgaccgatctccgcctccaagtctggcactcagcctcgctggccatcatggctccgaggctagagatggaggtnattacctactgccagtcgtcgaaagntcggttccggnggaaggactaaggctgacccgtcgtagtcaacgccaagggctaccggcccctaggtaccactctaccgttccccaacccttctacactagtaacgtagtcttgaggtccgggactcgggacaacggctacagttacgagcntacatcgacagagcgaagtcgngaacctgacgngacgntacgntagccanacgtactcagccctacnccancgtacncgacg

SEQ ID NO: 264679 - DNA, 622 bp, Homo sapiens
  misc_feature: GYAE6OF02IVPQP.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacggggctggagtgggtggaccaatataaggcacgatggacgtagcatgtactatgtggactctgtgaagggccgattcaccatctccagagacacgcccagactcactgtatctaggaaatgaccagcctgagagtcgaggacacggctatgtattactgtgcgaccatatcagcactggacgtcgcatctagaatacttcagctagttcggggaccacgggcctacccgtcggtacctacccgtcctccctccgaccgtccctaccaaccgaacgggccctacgttcccggttcccttcccccgtcgggtccccgtccccgtcgcctaccgaggaccgaccacccgtaccgacgaccgacaccgacggccggtcccggtcgggtccgtcggacccgtccgggtaaccgaaccgggttaccttacccgttacccgacctaacgttacggttacgtacgtacggg

SEQ ID NO: 264680 - DNA, 321 bp, Homo sapiens
  misc_feature: GYAE6OF02H80VX.24.53.E09.1.454.CMB.1.raw
  modified_base (288)..(288): a, c, t, g, unknown or other
  misc_feature (288)..(288): n is a, c, g, or t
  modified_base (290)..(321): a, c, t, g, unknown or other
  misc_feature (290)..(321): n is a, c, g, or t
tcagactactatgtcacgaccggtgctcgatttagagagagtgtgttgggtttgggggtgtggtggtctccactccgccttgacgggctgctatctgcctcgctggccatcactgggctccaggctgaggatgagggtgattactactgccagtcgtcgaagatgttcggcggaggactaagctcgacctcctaggtcagcccaagctcgcccctcggcactctcgtcccacctcctcacatacgtagtctagcgccgggctaggccaaagggcgcctaagtacggancnnnnnnnnnnnnnnnnnnnnnnnnnnnnnnnn

SEQ ID NO: 264681 - DNA, 283 bp, Homo sapiens; identical to SEQ ID NO: 264437
  misc_feature: GYAE6OF02HP0ZE.24.53.E09.1.454.CMB.1.raw
  modified_base (281)..(283): a, c, t, g, unknown or other
  misc_feature (281)..(283): n is a, c, g, or t

SEQ ID NO: 264682 - DNA, 390 bp, Homo sapiens
  misc_feature: GYAE6OF02FO80U.24.53.E09.1.454.CMB.1.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (379)..(390): a, c, t, g, unknown or other
  misc_feature (379)..(390): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtnattactactgccagtcgtcgaagatgtcggnggagggactaagctgaccgtcgtaggtcagcccaaggctcgcccccgtggtcactctcgttccccacctcctcactatagtagtctgagccgggctggcaaggcgcatagnnnnnnnnnnnn

SEQ ID NO: 264683 - DNA, 364 bp, Homo sapiens
  misc_feature: GYAE6OF02GTC4Y.24.53.E09.1.454.CMB.1.raw
  modified_base (279)..(279): a, c, t, g, unknown or other
  misc_feature (279)..(279): n is a, c, g, or t
  modified_base (289)..(291): a, c, t, g, unknown or other
  misc_feature (289)..(291): n is a, c, g, or t
  modified_base (293)..(294): a, c, t, g, unknown or other
  misc_feature (293)..(294): n is a, c, g, or t
  modified_base (296)..(296): a, c, t, g, unknown or other
  misc_feature (296)..(296): n is a, c, g, or t
  modified_base (298)..(364): a, c, t, g, unknown or other
  misc_feature (298)..(364): n is a, c, g, or t
tcagactactatgtcacgaccggtgctcgattttagagagagtgtgttggggtttgggggggtgtggtggtctccactcccgccttgacggggctgctatcctgcctcgctggccatcactgggctccaggctgaggatgagggtgattactactgccagtcgtcgaagatgttcggcggagggactaagctgacgtcctaggtcagcccaaggctgcccctggtcactctgttccccgccctctcacatagtagtctgagcgggctggacaaagggcncgaataggcnnncnntngnnnnnnnnnnnnnnnnnnnnnnnnnnnnnnnnnnnnnnnnnnnnnnnnnnnnnnnnnnnnnnnnnnn

SEQ ID NO: 264684 - DNA, 287 bp, Homo sapiens
  misc_feature: GYAE6OF02IGD1D.24.53.E09.1.454.CMB.1.raw
  modified_base (286)..(287): a, c, t, g, unknown or other
  misc_feature (286)..(287): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcacgcccaaggcctcgccccctggtcactctcgttccccaccctcctcacatagtagtctgaggcgggactggcaaggcgcatagnn

SEQ ID NO: 264685 - DNA, 605 bp, Homo sapiens
  misc_feature: GYAE6OF02JTI5F.24.53.E09.1.454.CMB.1.raw
  modified_base (165)..(165): a, c, t, g, unknown or other
  misc_feature (165)..(165): n is a, c, g, or t
  modified_base (543)..(543): a, c, t, g, unknown or other
  misc_feature (543)..(543): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (576)..(578): a, c, t, g, unknown or other
  misc_feature (576)..(578): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
  modified_base (603)..(605): a, c, t, g, unknown or other
  misc_feature (603)..(605): n is a, c, g, or t
tcagactactatgtcacgaccggtgctcgatttagagagagtgtgttgggtttgggggtcgtgtttttggaagctgcttgtaccagagggtcaccatctcctgcactgggagcaacatcggcgcaggttttgatgtccactggtacaagcagcttaccaaaaacncgcccccaaactcctcatttatcgtaacaacaatcggccctgtcgggtccctgaccgattcctccgcctcaagtctggccacctcacgcctcgctaggccatcactggacctccgagccgtgaggctcggagggtcaactttacactcgccaagtccgtacgaagtgtcgtacgggcggaacgggtactaagcgtacgaccgtacgtaggtaccaggacccgaagggtcctccggaccccccgttggtccaaccgtttcccgtccggttccccccaacccgttccctaccgaaccgtaagttaaccggttaacctccgtaccgggtaacggcccggggtcctacgggtaccgaaacgggtccgaccgtaaggttacgngctcgactcgattnacgtcgctgngaacgnacnnngnncngngcncncncnncncnngcnnn

SEQ ID NO: 264686 - DNA, 440 bp, Homo sapiens
  misc_feature: GYAE6OF02H1IHI.24.53.E09.1.454.CMB.1.raw
  modified_base (164)..(164): a, c, t, g, unknown or other
  misc_feature (164)..(164): n is a, c, g, or t
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (418)..(440): a, c, t, g, unknown or other
  misc_feature (418)..(440): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagcttccaaaaaacngaccccccaaactcctcatttatcgtaaacaacaatcggccctctggggtccctgaccgattcnccgcctcaagtctggcacctcagccctcgctggccatcactggctcagctgagatgagggtnattactactgccagtcgtcgaagntgtcggcggagggataagctgaccgtctagtcagccaagcncgcccctgcactctcgtcccgcctctcacatgtagtcngcggcggctgcgaaggcanactagnnnnnnnnnnnnnnnnnnnnnnn

SEQ ID NO: 264687 - DNA, 518 bp, Homo sapiens
  misc_feature: GYAE6OF02GMYFD.24.53.E09.1.454.CMB.1.raw
  modified_base (163)..(163): a, c, t, g, unknown or other
  misc_feature (163)..(163): n is a, c, g, or t
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (489)..(518): a, c, t, g, unknown or other
  misc_feature (489)..(518): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactcctcatttatcgtaacaacaatccggccctctggggtccctgaccgattctccgcctccaagtctggcacctcagcctcgctggccatccactgggcctccaggctggaggatggagggtnattacactcgcagtcgtacgaagnttggtcgggacgggagggactaagctcggaccgtccgtaggtccacgccccgaaggcctccgcccccgttggtccacgttcctccgttccccgcccttcctccaacgtatacgtacgtctggacggtcccgggctacgggctaacgggccgactaacgttagcngancnnnnnnnnnnnnnnnnnnnnnnnnnnnnnn

SEQ ID NO: 264688 - DNA, 640 bp, Homo sapiens
  misc_feature: GYAE6OF02IE8ZY.24.53.E09.1.454.CMB.1.raw
  modified_base (272)..(272): a, c, t, g, unknown or other
  misc_feature (272)..(272): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
  modified_base (509)..(509): a, c, t, g, unknown or other
  misc_feature (509)..(509): n is a, c, g, or t
  modified_base (544)..(544): a, c, t, g, unknown or other
  misc_feature (544)..(544): n is a, c, g, or t
tcagactactatgtcacgaccggtgctcgatttagagagagtgtgttgggtttgggaggcgttggtccagcctgggggtcccgtgagactctcctgtgcagcctctggattcccctttagtcgtacttttggatgaccgtggtccgccaggctccgagggacgggcgtggaggtgggtggaccaatataaggcacgatggacgtagcatgtactatgtggactctgtgaaggcgattcaccatctcagagacaacgccagaactcactgtanctagaaatgacagcctgagagtcgaggactagcgtatgtactactgagcgaccattancagcactgggatcgataccttagaacttcgtaccngactagttgggacccagggctacccgtggtaccaccggtcctcnccgtacgcctacccgacaacgggcccactaccgggtcctttccccgccgccgtcccgaccggttctacccggacgacggcccctaccgttaccccggaanaccgggcaaacccggacggcccggtttacccccgnggggtaccctccgggtacttccggggtaccgtaaaaggcccgtttaacccggttacccaacttaccggtttaaacggtcgttacccgttaacgggg

SEQ ID NO: 264689 - DNA, 625 bp, Homo sapiens
  misc_feature: GYAE6OF02IUNGY.24.53.E09.1.454.CMB.1.raw
  modified_base (325)..(325): a, c, t, g, unknown or other
  misc_feature (325)..(325): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtggccaaatataaggcacgatggacgtagcatgtactatgtggactctgtgaaggccgattcaccatctcagagacaacgcccagaactcactgatctagaaatgaccagcctgagagtcgaggacacggctatgtattactgtgcgacatancagcacctggacgtcgcaatctagtaactacttccagctaacggttcggggcccaaggggtccctaacccgtcgggtaccctaacccggttccttaccctctacgcccctacccaaccggaaacccgggtcccaccggttacccggttcccctttccccccgtgggccccgtcccgttacggccctaccgacggtacgccctaccgtccgacgacgccacgacgcccgcccgtggtcctcggtccctgggtaccaacggtacctttaaccgtaccaacgtacttacggtacgtccgtagg

SEQ ID NO: 264690 - DNA, 499 bp, Homo sapiens
  misc_feature: GYAE6OF02JU49F.24.53.E09.1.454.CMB.1.raw
  modified_base (188)..(188): a, c, t, g, unknown or other
  misc_feature (188)..(188): n is a, c, g, or t
  modified_base (254)..(254): a, c, t, g, unknown or other
  misc_feature (254)..(254): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (467)..(467): a, c, t, g, unknown or other
  misc_feature (467)..(467): n is a, c, g, or t
  modified_base (469)..(499): a, c, t, g, unknown or other
  misc_feature (469)..(499): n is a, c, g, or t
tcagactactatgtcacgaccggtgctcgatttagagagagtgtgttgagtttggggggctgtttttggaagctgcttgtaccagagggtcaccatctcctgcactgggagcaacatcggcgcaggttttgatgtccactggtacaagcagcttaccaaaaacacgccccccaaaactcctcatttanccgtaaacaaacaatcggccctctggggtccctgaccgattcctccgcctccaagtctggccaccncacgcctcgctggcctaatcactgggctccgaggctgaggatggaggtgtacttactactcgccagttcgacgaagngtgtcgggnggagggactaagctgaccgtctaggcacgcccgagcctaccgccccgtgtcactctcgtcccctaccctcgtacacaagttcgtatcgtcggaggcccggtcgtacggacgacggccgacagtagcngnnnnnnnnnnnnnnnnnnnnnnnnnnnnnnn

SEQ ID NO: 264691 - DNA, 280 bp, Homo sapiens
  misc_feature: GYAE6OF02FJQYQ.24.53.E09.1.454.CMB.1.raw
  modified_base (279)..(280): a, c, t, g, unknown or other
  misc_feature (279)..(280): n is a, c, g, or t
tcagactactatgtcacgaccggtgctcgatttagagagagtgtgttgggtttgggggtgtggtggtctccactcccgccttgacggggctgctatctgcctcgctggccatcactggctccaggctgaggatgagggtgattactactgccagtcgtcgaagatgttcggcggagggactaagctgaccgtcctaggtcagcccaaggctgccccctggtcactctgttccccaccctcctcacatagtagtctgagcgggctggcaaggcgcatagnn

SEQ ID NO: 264692 - DNA, 288 bp, Homo sapiens
  misc_feature: GYAE6OF02G9SXA.24.53.E09.1.454.CMB.1.raw
  modified_base (280)..(288): a, c, t, g, unknown or other
  misc_feature (280)..(288): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctgttccccgccctcctcacatagtagtctgagcgggctggcaaggcgcatagnnnnnnnnn

SEQ ID NO: 264693 - DNA, 494 bp, Homo sapiens
  misc_feature: GYAE6OF02HRF0F.24.53.E09.1.454.CMB.1.raw
  modified_base (162)..(162): a, c, t, g, unknown or other
  misc_feature (162)..(162): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (410)..(410): a, c, t, g, unknown or other
  misc_feature (410)..(410): n is a, c, g, or t
  modified_base (457)..(457): a, c, t, g, unknown or other
  misc_feature (457)..(457): n is a, c, g, or t
  modified_base (469)..(494): a, c, t, g, unknown or other
  misc_feature (469)..(494): n is a, c, g, or t
tcagactactatgtcacgaccggtgctcgatttagagagagtgtgttgggtttgggggctgtttttggaagctgcttgtaccagagggtcatcatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggccacctcagcctcgctggccatcactgggctccgaggctgaggatggagggtnattacactgcctagtcgtagaagtnttcggttcgggacgggagggactaagctagaccgtcctaggtcacgcccgaagcctccgcccctggtcactccgtccgttccccacccttcncactacgtagtacttcgtggacggcgggtctcgggaccgaagggccncgaagtagcgtnnnnnnnnnnnnnnnnnnnnnnnnnn

SEQ ID NO: 264694 - DNA, 418 bp, Homo sapiens
  misc_feature: GYAE6OF02ITX7S.24.53.E09.1.454.CMB.1.raw
  modified_base (111)..(111): a, c, t, g, unknown or other
  misc_feature (111)..(111): n is a, c, g, or t
  modified_base (388)..(389): a, c, t, g, unknown or other
  misc_feature (388)..(389): n is a, c, g, or t
  modified_base (391)..(418): a, c, t, g, unknown or other
  misc_feature (391)..(418): n is a, c, g, or t
tcagactactatgtcacgaccggtgctcgatttagagagagtgtgttgggtttggggagcaacatcggcgcaggttttgatgtccactggtacaagcagcttccaaaaacngccccccaaactcctcatttatcgtaacaaacaatcggccctctggggtccctgaccgattctccgcctccaagtctggcacctcagcctcgctggccatcactgggctccaggctgaggatggagggtgattactactgccagtcgtcgaagatgttcggcggagggactaagctgaccgtcctaggtcacgcccaaggctcgccccctggtcacctctcgtccccaccctcctcacatagtagtctgagcggggctggacaagggcgacagtagnngnnnnnnnnnnnnnnnnnnnnnnnnnnnn

SEQ ID NO: 264695 - DNA, 467 bp, Homo sapiens
  misc_feature: GYAE6OF02HR8M3.24.53.E09.1.454.CMB.1.raw
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (451)..(467): a, c, t, g, unknown or other
  misc_feature (451)..(467): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaactcctcatttatcgtaacaacaatcggccctcgtcgggtccctgaccgattctccgcctccaagtctggccacctcagccctcgctggccatcactgggctccgaggctgaggatggagggtgattaactacncgccgagtcgcgaagatggttcggngggagggactaaggcctgccgtccgtaggtcacggacccagggcctcggcccctcgtcnctctctcccaccctccacncagttgtatcgagcgcgggtctcgggacgtaggccgtanagtgnnnnnnnnnnnnnnnnn

SEQ ID NO: 264696 - DNA, 568 bp, Homo sapiens
  misc_feature: GYAE6OF02GAAR8.24.53.E09.1.454.CMB.1.raw
  modified_base (162)..(162): a, c, t, g, unknown or other
  misc_feature (162)..(162): n is a, c, g, or t
  modified_base (294)..(294): a, c, t, g, unknown or other
  misc_feature (294)..(294): n is a, c, g, or t
  modified_base (537)..(538): a, c, t, g, unknown or other
  misc_feature (537)..(538): n is a, c, g, or t
  modified_base (540)..(568): a, c, t, g, unknown or other
  misc_feature (540)..(568): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaactcctcatttatcgtaacaacaatcggccctctggggtccctgaccgattctccgcctccaagtctggcacctcagcctcgctggccatcacgtgggcctccaggctgaggatggagggtnattactactgccaggtcgtacgaagatggttcggcggagggactaagctacggacccgtccgtaggtccacggaccccaagggcctcccggaccccccgttcgggtacctaccgttccttacccggtttccccccgccccctttccctacaacccgtattaacggttacgtccgttagggaccgggtccggggtaccgttacggggaccgaaacggggccgtaccgaagttaacggcatgacnngnnnnnnnnnnnnnnnnnnnnnnnnnnnnn

SEQ ID NO: 264697 - DNA, 394 bp, Homo sapiens
  misc_feature: GYAE6OF02FUPX0.24.53.E09.1.454.CMB.1.raw
  modified_base (383)..(394): a, c, t, g, unknown or other
  misc_feature (383)..(394): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctcgccccctcggtccactctcgttccccgccctcctcacatacgtagtcctgagcgggctggcaaggcgcagtagnnnnnnnnnnnn

SEQ ID NO: 264698 - DNA, 466 bp, Homo sapiens
  misc_feature: GYAE6OF02IGV0M.24.53.E09.1.454.CMB.1.raw
  modified_base (441)..(466): a, c, t, g, unknown or other
  misc_feature (441)..(466): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagcccccaaatcctcattttatcgtaacaacaatcggccctctggggtccctgaccgattctccgcctccaagtctggcacctcagcctcgctggccatcactgggctccatgctgaggatggaggtgattactactgccaggtcgtcgaagatgttcggcggagggactaagctgaccgtctaggtcacgccaaggcctcgccccctcggtcacttctcgttccccgccctcctcaacattagtacgtcctggacgcgggctgggacaaggcgcagtgnnnnnnnnnnnnnnnnnnnnnnnnnn

SEQ ID NO: 264699 - DNA, 532 bp, Homo sapiens
  misc_feature: GYAE6OF02FHHCE.24.53.E09.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
  modified_base (486)..(489): a, c, t, g, unknown or other
  misc_feature (486)..(489): n is a, c, g, or t
  modified_base (491)..(492): a, c, t, g, unknown or other
  misc_feature (491)..(492): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (511)..(514): a, c, t, g, unknown or other
  misc_feature (511)..(514): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (530)..(532): a, c, t, g, unknown or other
  misc_feature (530)..(532): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttancgtaacaacaatcggccctntggggtccctgaccgattctccgcctccaagtcctggcacctcgacgcctcgctcggcccatccacgtgggcctccaggctggacggtatgagggtnattactacngccagtcgtcgaagngtcggtcggcggagggactaaggctcgaccgtctaggtcacggcccaggctcgcccctggtacactctcgttccccacctcctacacgtactacgtgtctggacggtccgggtctacgggccgtaaacgggccgaccgtagtacggtanccgatctacgnacnnnncnncgacgncnctactntgncnnnncagngcncgcgngcgnnn

SEQ ID NO: 264700 - DNA, 484 bp, Homo sapiens
  misc_feature: GYAE6OF02I9CHG.24.53.E09.1.454.CMB.1.raw
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (440)..(440): a, c, t, g, unknown or other
  misc_feature (440)..(440): n is a, c, g, or t
  modified_base (450)..(463): a, c, t, g, unknown or other
  misc_feature (450)..(463): n is a, c, g, or t
  modified_base (465)..(484): a, c, t, g, unknown or other
  misc_feature (465)..(484): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaaacaacaatcggccctntggggtccctgaccgattcnccgcctccaagtctggcacctcagcctcgctggcccatcactgggctccaggcctgaaggatgacgggtnattacactgcccagtcgtcgaagntcgttccggcggagggtactaagctcgaccgtcctaggtcagcccgaaggcctcgcccctggtcactctcgttcccaccctctacactatcgtagtctggacgcgggcgtaggcaaacggtcntactgacgcnnnnnnnnnnnnnncnnnnnnnnnnnnnnnnnnnn

SEQ ID NO: 264701 - DNA, 552 bp, Homo sapiens
  misc_feature: GYAE6OF02H8HF4.24.53.E09.1.454.CMB.1.raw
  modified_base (404)..(404): a, c, t, g, unknown or other
  misc_feature (404)..(404): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctctagggacggggctggagtgggtggccaatataaggcacgatggacgtagcatgtactatgtggactctgtgaagggccgattcaccatctccagagacaacgcccagaacctcactgtatctggaaatgaccagtctgagagtcgaggacacggctatgtattactgtgcgaccatatcagcactggatcgcatctagaatacttccagcagttggggcccagggccacccgtggtcacccgtctcctcacncctccaccgaacggcccagtccggtccttcccctggccgccctgcctccaggacgccaccgtccgagacgcacgacgccgccgtcgggctcggtcctgggtaccaacggtaccttaccttaccacgtaacgtacgttacgtcgttcgg

SEQ ID NO: 264702 - DNA, 462 bp, Homo sapiens
  misc_feature: GYAE6OF02FMAW8.24.53.E09.1.454.CMB.1.raw
  modified_base (162)..(162): a, c, t, g, unknown or other
  misc_feature (162)..(162): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (441)..(442): a, c, t, g, unknown or other
  misc_feature (441)..(442): n is a, c, g, or t
  modified_base (444)..(462): a, c, t, g, unknown or other
  misc_feature (444)..(462): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattctccgcctccaagtctggcacctcagcctcgctggccatccactgggctccaggctgaggatggaggtgattactactgccaggtcgtcgaagatgttcggcggagggactaagctcgaccgtctaggtcagcccaaggcctcgccccctggtccactctcgttccccgccctccncacatagtacgtctaggngcgggctggacgaacggcgcaagtgnngnnnnnnnnnnnnnnnnnnn

SEQ ID NO: 264703 - DNA, 526 bp, Homo sapiens
  misc_feature: GYAE6OF02JAQ0P.24.53.E09.1.454.CMB.1.raw
  modified_base (162)..(162): a, c, t, g, unknown or other
  misc_feature (162)..(162): n is a, c, g, or t
  modified_base (185)..(185): a, c, t, g, unknown or other
  misc_feature (185)..(185): n is a, c, g, or t
  modified_base (491)..(491): a, c, t, g, unknown or other
  misc_feature (491)..(491): n is a, c, g, or t
  modified_base (496)..(526): a, c, t, g, unknown or other
  misc_feature (496)..(526): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcattttancgtaacaacaatcggccctctggggtccctgaccgattctccgcctccaagtctggcacctcagcctcgctggccatcactgggctccaggctgagatggagggtgattactactcgccagtccgtcgaagagttcggttcgggacggaagggtactaaggcgtgtacccgtcctaggtccagaccccgaaggcctccggcccccgtggtccactccttccgttcccccaaccccgtccctacgactacgtagtacgtcctggacggtaccgggtcgttcgggacgaacgggtccgacctagtagntacgnnnnnnnnnnnnnnnnnnnnnnnnnnnnnnn

SEQ ID NO: 264704 - DNA, 481 bp, Homo sapiens
  misc_feature: GYAE6OF02GIWG9.24.53.E09.1.454.CMB.1.raw
  modified_base (162)..(162): a, c, t, g, unknown or other
  misc_feature (162)..(162): n is a, c, g, or t
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (452)..(481): a, c, t, g, unknown or other
  misc_feature (452)..(481): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactggctccaggctgagatggagggtgattactactgccagtcgtcgaagatgttcggcggaggactaagctacgaccgtctaggtcagcccagctcgcccctgcactctcgtcccacctcctcactntagtacgtctggacgccgggtctcgggacgaacgggccgaccgagttacgncgntcgatcgnnnnnnnnnnnnnnnnnnnnnnnnnnnnnn

SEQ ID NO: 264705 - DNA, 395 bp, Homo sapiens
  misc_feature: GYAE6OF02G1TCI.24.53.E09.1.454.CMB.1.raw
  modified_base (376)..(376): a, c, t, g, unknown or other
  misc_feature (376)..(376): n is a, c, g, or t
  modified_base (383)..(395): a, c, t, g, unknown or other
  misc_feature (383)..(395): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggaggtgattactactgccagtcgtacgaagatgttcggcggagggactaagctgaccgtcctagggtcagcccaaggctcgccccctcggtcactctcgttccccaccctcctcactatagtagtctgagcgggctggcaaggcncagtagnnnnnnnnnnnnn

SEQ ID NO: 264706 - DNA, 405 bp, Homo sapiens
  misc_feature: GYAE6OF02FFTGU.24.53.E09.1.454.CMB.1.raw
  modified_base (110)..(110): a, c, t, g, unknown or other
  misc_feature (110)..(110): n is a, c, g, or t
  modified_base (238)..(238): a, c, t, g, unknown or other
  misc_feature (238)..(238): n is a, c, g, or t
  modified_base (387)..(405): a, c, t, g, unknown or other
  misc_feature (387)..(405): n is a, c, g, or t
tcagactactatgtcacgaccggtgctcgatttagagagagtgtgttgggtttgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatggagggtnattacactgccagtcgtcgaagatgttcggcggagggactaagctgaccgtcctaggtcagcccaaggctcgccccctgtcactctcgttccccgcccttcctcactatagtacgtctggagcggggctggacaacgggcgacagtagnnnnnnnnnnnnnnnnnnn

SEQ ID NO: 264707 - DNA, 277 bp, Homo sapiens
  misc_feature: GYAE6OF02H9U11.24.53.E09.1.454.CMB.1.raw
  modified_base (277)..(277): a, c, t, g, unknown or other
  misc_feature (277)..(277): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtctaggtcagcccaaggctgccccctggtcactctcgttcccaccctcctcacatagtagtctgagcggctggcaaggcgcatagn

SEQ ID NO: 264708 - DNA, 611 bp, Homo sapiens
  misc_feature: GYAE6OF02I8LP9.24.53.E09.1.454.CMB.1.raw
  modified_base (163)..(163): a, c, t, g, unknown or other
  misc_feature (163)..(163): n is a, c, g, or t
  modified_base (234)..(234): a, c, t, g, unknown or other
  misc_feature (234)..(234): n is a, c, g, or t
  modified_base (319)..(319): a, c, t, g, unknown or other
  misc_feature (319)..(319): n is a, c, g, or t
  modified_base (584)..(611): a, c, t, g, unknown or other
  misc_feature (584)..(611): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaaactcctcatttatcgtaaacaacaatcggccctctcgggggtcccctagaccgtacttccncccgtccctaccaacgtctcggaccacctcgacgccctcgcgtcggccatccacgtcgggctccgaggctggagagtggagggtntattactatcgcgtacgtcgtacggaatggttgggtccggacgggaaggggtaactaagtccgtacgacccggtccgtaggaccaccggacccgaaggtccctccccgcccccgtacggttacctaccgttccgttacccgttaccccctacccccttccctaaccctaacgttaacggttaacgggttccgttaccggtagggtacccggggtcccggggtcgtaacgggacccggtaacgggtccctaagtaggtcgatcgcnnnnnnnnnnnnnnnnnnnnnnnnnnnn

SEQ ID NO: 264709 - DNA, 434 bp, Homo sapiens
  misc_feature: GYAE6OF02IZKM0.24.53.E09.1.454.CMB.1.raw
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(434): a, c, t, g, unknown or other
  misc_feature (430)..(434): n is a, c, g, or t
tcagactactatgtcacgaccggtgctcgatttagagagagtgtgttgagtttgggggctgtttttggaagctgcttgtaccagagggtcaccatctcctgcactggggagcaacatcggcgcaggttttgatgtccactggtacaagcagcttaccaaaaacagccccccaaactcctcatttatcgtaaacaacaatcggccctctggggtccctgaccgattctccgcctcaagtctgcacctcagcctcgctggccatcactggctccaggctgaggatggagggtgattactactgccagtcgtcgaagatgttcgggcggagggactaagctgaccgtctaggtcacgaccaaggctcgcccctcggtcactctcgttcccaccctctcactatagtagtctgngcggctggacaggcncangnnnnn

SEQ ID NO: 264710 - DNA, 291 bp, Homo sapiens
  misc_feature: GYAE6OF02HHM06.24.53.E09.1.454.CMB.1.raw
  modified_base (281)..(291): a, c, t, g, unknown or other
  misc_feature (281)..(291): n is a, c, g, or t
tcagactactatgtcacgaccggtgctcgatttagagagagtgtgttgggtttgggggtgtggtggtctccactcccgccttgacggggctgctatctgcctcgctggccatcactggctccaggctgaggatgagggtgattactactgccagtcgtcgaagatgttcggcggagggactaagctgaccgtctaggtcagcccaaggctcgccccctggtcactctcgttcccaccctcctcacatagtagtctgagcgggctggacaaggcgacatagnnnnnnnnnnn

SEQ ID NO: 264711 - DNA, 301 bp, Homo sapiens
  misc_feature: GYAE6OF02FF5CD.24.53.E09.1.454.CMB.1.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (282)..(301): a, c, t, g, unknown or other
  misc_feature (282)..(301): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagtccaaggctgccccctggtcactctgttccccaccctcctnacatagtagtctgaggccgggntggcaaggcgcatagnnnnnnnnnnnnnnnnnnnn

SEQ ID NO: 264712 - DNA, 503 bp, Homo sapiens
  misc_feature: GYAE6OF02IJKAG.24.53.E09.1.454.CMB.1.raw
  modified_base (165)..(165): a, c, t, g, unknown or other
  misc_feature (165)..(165): n is a, c, g, or t
  modified_base (300)..(300): a, c, t, g, unknown or other
  misc_feature (300)..(300): n is a, c, g, or t
  modified_base (450)..(450): a, c, t, g, unknown or other
  misc_feature (450)..(450): n is a, c, g, or t
  modified_base (471)..(503): a, c, t, g, unknown or other
  misc_feature (471)..(503): n is a, c, g, or t
tcagactactatgtcacgaccggtgctcgatttagagagagtgtggttgggtttgggggctgtttttggaagctgcttgtaccagagggtcaccatctcctgcactgggagcaacatcggcgcaggttttgatgtccactggtacaagcagctttaccaaaaacngaccccccaaaactcctacatttatcgtaacaacaatccggccctctgggtccctgaccgattcgccgcctcaagtctcggcacctcagcctcgcctggccatcacgtcgggctcacggctgaggatggagggtnaattactacgtgccagtcgtacggaagacgttggttcggcggaagggactaagctagaccgtcctaggtcagcccgtaaggctccggcccctggtccacgttcgtccgttaccccgccctcctcactattagtactccgtaggcgcgggnttcgacgaaggcacagtacgnnnnnnnnnnnnnnnnnnnnnnnnnnnnnnnnn

SEQ ID NO: 264713 - DNA, 541 bp, Homo sapiens
  misc_feature: GYAE6OF02HYBP4.24.53.E09.1.454.CMB.1.raw
  modified_base (165)..(165): a, c, t, g, unknown or other
  misc_feature (165)..(165): n is a, c, g, or t
  modified_base (186)..(186): a, c, t, g, unknown or other
  misc_feature (186)..(186): n is a, c, g, or t
  modified_base (291)..(291): a, c, t, g, unknown or other
  misc_feature (291)..(291): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(528): a, c, t, g, unknown or other
  misc_feature (512)..(528): n is a, c, g, or t
  modified_base (530)..(541): a, c, t, g, unknown or other
  misc_feature (530)..(541): n is a, c, g, or t
tcagactactatgtcacgaccggtgctcgatttagagagagtgtgttgagtttggggggctgtttttggaagctgcttgtaccagagggtcaccatctcctgcactgggagcaacatcggcgcaggttttgatgtccactggtacaagcagcttaccaaaaaacngcccccaaactcctcatttancgtaacaacaatccggccctgtcggggtccctgaccgtattcctccgcctccaagtctggcactcagcctcgctgccatcactggctccagctgaggatgaggtntatactactgcagtcgtagaagatggttacgggcggaggggtaataaggctacggaccgtccgttaggccacggtcccaagggtcctacgccccccgttggtacctaccgttccgttcggttccccccgcccttcccgtacctacgtaacgttaggttacgtccgttaggaacggtcgggaccgtacgggacgaacggggccgtactaaagttagcngngnnnnnnnnnnnnnnnnngnnnnnnnnnnnn

SEQ ID NO: 264714 - DNA, 441 bp, Homo sapiens
  misc_feature: GYAE6OF02GT8B5.24.53.E09.1.454.CMB.1.raw
  modified_base (162)..(162): a, c, t, g, unknown or other
  misc_feature (162)..(162): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (426)..(441): a, c, t, g, unknown or other
  misc_feature (426)..(441): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngcccccaaactcctcatttatcgtaacaacaatcggccctctggggtccctgaccgattctccgcctccaagtctggcacctcagcctcgctggccatccacgtgggctccaggctgaggatggagggtnattactactgccagtcgtacgaagntgttcgggcggagggactaagctgaccgtctagtcagccaaggctcgcccctggtcactctcgtcccaccctcncacatgtagtcngngcggctggcaggcgcagtagnnnnnnnnnnnnnnnn

SEQ ID NO: 264715 - DNA, 286 bp, Homo sapiens
  misc_feature: GYAE6OF02I7F5W.24.53.E09.1.454.CMB.1.raw
  modified_base (281)..(286): a, c, t, g, unknown or other
  misc_feature (281)..(286): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttcccgccctcctcacatagtagtctgagcgggctggcaaggcgcatagnnnnnn

SEQ ID NO: 264716 - DNA, 472 bp, Homo sapiens
  misc_feature: GYAE6OF02HOOGS.24.53.E09.1.454.CMB.1.raw
  modified_base (164)..(164): a, c, t, g, unknown or other
  misc_feature (164)..(164): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (436)..(436): a, c, t, g, unknown or other
  misc_feature (436)..(436): n is a, c, g, or t
  modified_base (443)..(472): a, c, t, g, unknown or other
  misc_feature (443)..(472): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacngcccccaaactcctcatttatcgtaaacaacaatcggccctctggggtccctgaccgattctccgcctccaagtctggcacctcagcctcgctggccatcactggctcaggctgagatgaggtnattacactgaccagtcgtcgaagnttggtcggacggagggactaagcgtagaccgtcgtaggtcagacccaaggcctcgccccctggtcactctcgtcccgccctccacacagtagtacgtctaggacgcggggctgggacaagggcncgatagnnnnnnnnnnnnnnnnnnnnnnnnnnnnnn

SEQ ID NO: 264717 - DNA, 285 bp, Homo sapiens
  misc_feature: GYAE6OF02G6LOU.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttcccgccctcctcacatagtagtctgagcgggctggcaaggcgcatagnnnnnn

SEQ ID NO: 264718 - DNA, 465 bp, Homo sapiens
  misc_feature: GYAE6OF02G8G3Z.24.53.E09.1.454.CMB.1.raw
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
  modified_base (434)..(465): a, c, t, g, unknown or other
  misc_feature (434)..(465): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacagccccccaaactcctcatttatcgtaacaacaatcggccctctggggtccctgaccgattctccgcctccaagtctggcacctcagcctcgctggccatcactgggctccaggctgaggatgaggtgattactactgcagtcgtacgaagatggttcggcggagggactaagctgaccgtctaggtcagcccaaggctcgcccctgtcnctctcgtcccacctccncacatagtagtctgacgcgggactggacgaacggcgcaagtacgnnnnnnnnnnnnnnnnnnnnnnnnnnnnnnnn

SEQ ID NO: 264719 - DNA, 607 bp, Homo sapiens
  misc_feature: GYAE6OF02IOQJU.24.53.E09.1.454.CMB.1.raw
  modified_base (162)..(162): a, c, t, g, unknown or other
  misc_feature (162)..(162): n is a, c, g, or t
  modified_base (305)..(305): a, c, t, g, unknown or other
  misc_feature (305)..(305): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagactactatgtcacgaccggtgctcgatttagagagagtgtgttgggtttggggctgtttttggaagctgcttgtaccagagggtcaccatctcctgcactgggagcaacatcggcgcaggttttgatgtccactggtacaagcagcttaccaaaaacncgcccccaaatcctcatttactcgtaacaacaatccggccctcgtggggtccctgaccgattcctccgcctaccaagttctggccacctcacgcctcgtctcggccatcacgtcgggctccgaggctggagagtcggagggtntacttactacgtcgaccacgttcggtacgaaagtcgttcggtcgggacgggtacggtaactaacggcttacgggaaccttcgtaacggtcacgtcccgaaggcctaccgtccccgtggtacccaacgtttccgtaccgttcccccacccttccgtaccacgttaagttaccgtacgttcgtaacgcgggtccgggtgtacggaccgtaacggccgtacttacgacggctcgcgtncgagcgnacgancgcgacncgtcgcgcgagngacncgcgcgcgcgncgncnctcgtcncnctacgtc

SEQ ID NO: 264720 - DNA, 280 bp, Homo sapiens; identical to SEQ ID NO: 263573
  misc_feature: GYAE6OF02FUL5J.24.53.E09.1.454.CMB.1.raw
  modified_base (280)..(280): a, c, t, g, unknown or other
  misc_feature (280)..(280): n is a, c, g, or t

SEQ ID NO: 264721 - DNA, 513 bp, Homo sapiens
  misc_feature: GYAE6OF02IY4VS.24.53.E09.1.454.CMB.1.raw
  modified_base (163)..(163): a, c, t, g, unknown or other
  misc_feature (163)..(163): n is a, c, g, or t
  modified_base (226)..(226): a, c, t, g, unknown or other
  misc_feature (226)..(226): n is a, c, g, or t
  modified_base (470)..(470): a, c, t, g, unknown or other
  misc_feature (470)..(470): n is a, c, g, or t
  modified_base (477)..(478): a, c, t, g, unknown or other
  misc_feature (477)..(478): n is a, c, g, or t
  modified_base (481)..(513): a, c, t, g, unknown or other
  misc_feature (481)..(513): n is a, c, g, or t
tcagactactatgtcacgaccggtgctcgatttagagagagtgtgttgggtttgggggctgttttggaagctgcttgtaccagagggtcaccatctcctgcactgggagcaaacatcggcgcaggttttgatgtccactggtacaagcagcttccaaaaaacngccccccaaactcctcatttatcgtaacaacaatcggccctctggggtccctgaccgattccnccgcctccaagtctggccacctcacgccctcgctggtcatacactgggcctccgaggtctggaggtatggagggtgaatttacgtactaggccaggtccgtagaagtatcggttcggcggagggactaagccgtgacccgtctagccacgtccgaagcctccgccccgtggcacttcctacgtcccccaccctcctacgactagtacgtagttctggacggtccgggctcgggacaagggccgnacggtannctnnnnnnnnnnnnnnnnnnnnnnnnnnnnnnnnn

SEQ ID NO: 264722 - DNA, 617 bp, Homo sapiens
  misc_feature: GYAE6OF02GOT8D.24.53.E09.1.454.CMB.1.raw
  modified_base (186)..(186): a, c, t, g, unknown or other
  misc_feature (186)..(186): n is a, c, g, or t
  modified_base (316)..(316): a, c, t, g, unknown or other
  misc_feature (316)..(316): n is a, c, g, or t
  modified_base (581)..(581): a, c, t, g, unknown or other
  misc_feature (581)..(581): n is a, c, g, or t
  modified_base (585)..(602): a, c, t, g, unknown or other
  misc_feature (585)..(602): n is a, c, g, or t
  modified_base (604)..(617): a, c, t, g, unknown or other
  misc_feature (604)..(617): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccatggtacaagcagcttaccaaaaacacgaccccccaaactcctcatttancgtaaacaacaatccggccctcgtcggggtccctgaccgtacttcctcccgccctaccaagttcctggccacctcagcctcgctcggcccatccacgtcggcctccgaggctaggaggagtggaggggtntaacttaccgtacgtcgaccgtaggtcgtaggaagtacgttgggttccgggacgggagggtaactaaggcgtacggacccgttacgtacggtcaaccggacccgaaggtccgtacccggtccccccgttacgggtcctaccgtttccgttccccggtttccccccgtccccttcctacccgaaccgttaagttacggttacgtttccgagggtccgggtccgggtaccgtacgggaccggaacgggccggtacgtaacgtagcgncgannnnnnnnnnnnnnnnnngnnnnnnnnnnnnnn

SEQ ID NO: 264723 - DNA, 454 bp, Homo sapiens
  misc_feature: GYAE6OF02FZC1G.24.53.E09.1.454.CMB.1.raw
  modified_base (436)..(454): a, c, t, g, unknown or other
  misc_feature (436)..(454): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatggttcggcggagggactaagctgaccgtcctaggtcagcccaaggctcgccccctggtccactctcgttccccaccctcctcacatacgtagtctgacgcgggctgggcaaggcgcatagnnnnnnnnnnnnnnnnnnn

SEQ ID NO: 264724 - DNA, 686 bp, Homo sapiens
  misc_feature: GYAE6OF02IBPX3.24.53.E09.1.454.CMB.1.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccgagggacggggctggagtgggtggccaatataaggcacgatggacgtagcatgtactatgtgactctgtgaaggccattcaccatcncagagacaacgccagaactcactgtatctagaaatgaccagcctgagngacgagacacggctagtagtaacttactgtcgacgaaccatactacgagcacctggactcgactattctagaaacttacttccaagctaagttcggggaccagggcctacccgtggtccctaacccgtcttcctacgaccgtccctacccgaacccgtaacgggacccctaagttcccggttaccccttccccccgtcgggaccccgtccccgtcgtacccgtacccgaacgggaccgtcccgtaacccgttacccggaacgaccggactaacccgacggcccgggtaccccgtacgggggtccgtcgggtaccccgttacggggtaacccgtaaacgggtacccttaacccgtttaccctaaccgttaacgttaacggttacgtacggttaacggg

SEQ ID NO: 264725 - DNA, 501 bp, Homo sapiens
  misc_feature: GYAE6OF02IIA1R.24.53.E09.1.454.CMB.1.raw
  modified_base (165)..(165): a, c, t, g, unknown or other
  misc_feature (165)..(165): n is a, c, g, or t
  modified_base (235)..(235): a, c, t, g, unknown or other
  misc_feature (235)..(235): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
  modified_base (473)..(501): a, c, t, g, unknown or other
  misc_feature (473)..(501): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccaactggtacaagcagcttaccaaaaaacngccccccaaaactcctcatttatcgtaaacaacaatcggccctcgtggggtccctgaccgtattcctccncctccaagtctggccacctcagccctcgctggccatcactgggctccgaggctaggaggatggtaggtgacttactactgcctagtcggtacgaacgtattcggttcgggcggtagggaactaaggctacgacccgtactaggtcacgacccaaggcctcgccccctggtcactctcgtccccgcctccncacatagtactcgngaggcggtctggacaagggccgngtacgtagcgnnnnnnnnnnnnnnnnnnnnnnnnnnnnn

SEQ ID NO: 264726 - DNA, 570 bp, Homo sapiens
  misc_feature: GYAE6OF02HB44Z.24.53.E09.1.454.CMB.1.raw
  modified_base (409)..(409): a, c, t, g, unknown or other
  misc_feature (409)..(409): n is a, c, g, or t
tcagactactatgtcacgaccggtgctcgatttagagagagtgtgttgggtttggggaggcttggtccagcctggggggtccctgagactctcctgtgcagcctctggattcccctttagtgtactttttggatgacctgggtccgccaggctccagggacggggctggagtgggtggccaatataaggcacgatggacgtagcatgtactatgtggactctgtgaagggccgattcaccatctccagagacaacgcccagaactcactgtatctaggaaatgaccagcctgagagtcgaggacacggctatgtattactgtgcgaccatatcagcaccgtggagtcgcatctagaactcttcagctagttcggggccagggccacccgtggtccaccgtctcctcacncctccaccgaacgggcccagtccgttcccttccccgtggcccgtccctgccctccgacggcgccacccgtccgacgacgcaccgacggccggcccgtcgggcctcggcccgttggtaccgaacggtacctaccttccgaactagttacgtacgtctacggg

SEQ ID NO: 264727 - DNA, 573 bp, Homo sapiens
  misc_feature: GYAE6OF02GJ8TJ.24.53.E09.1.454.CMB.1.raw
  modified_base (254)..(254): a, c, t, g, unknown or other
  misc_feature (254)..(254): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagactactatgtcacgaccggtgctcgatttagagagagtgtgttgggtttgggaggcttggtccagccgtggggggtccctgagactctcctgtgcagcctctggactttcccctttagtgtactttttggatgacctgggtccgccaggctccgagggacgggctggagtgggtgccaatataaggcacgatggacgtagcatgtactatgtggactctgtgaagggccgtattccaccatctccagganacaaccgcccaagaacctcactgtatctaggaaatgaccagcctgagagtcgaggacacggctatgtattacgtgtgcgacatatcagcaccgtggagtcgcatcagaactctcagctagttcggggccacgggcacccgtggtaccacccgtctacctcacgccctaccaccgaaccgggtcccattccggtaccccttcccgnggcccgccctgccgtccgaggacncctacccgtcgagccgcacgcggccgtccgtcgggctcgccgttggaccaacggtccttaccgttccaatacgtacgtacgtcgtacggg

SEQ ID NO: 264728 - DNA, 560 bp, Homo sapiens
  misc_feature: GYAE6OF02JFE5P.24.53.E09.1.454.CMB.1.raw
  modified_base (163)..(163): a, c, t, g, unknown or other
  misc_feature (163)..(163): n is a, c, g, or t
  modified_base (187)..(187): a, c, t, g, unknown or other
  misc_feature (187)..(187): n is a, c, g, or t
  modified_base (297)..(297): a, c, t, g, unknown or other
  misc_feature (297)..(297): n is a, c, g, or t
  modified_base (348)..(348): a, c, t, g, unknown or other
  misc_feature (348)..(348): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(529): a, c, t, g, unknown or other
  misc_feature (527)..(529): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (537)..(560): a, c, t, g, unknown or other
  misc_feature (537)..(560): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgcccccaaactcctcattttacncgtaaacaacaattccggccctcgtcggggtccctgacccgatttccgtcccgcctaccaagtcctggccacctcagcctcgctggccatcactggctccaggctgaggngtggaggggtctattactacgtgaccgagttcgtacgagacgtggtacggngggaaggactaagctcggaccgtctaggtcacggtcccgaaggtcgtccgtacccccgtggtcctaacgttccgtccggtttacccccgcccttcctaacctaacgtacgtaaccgttacggtacgtcgggaacggtcgggccgtacggcggaacgaccggctaatcggacncnngngnnnacngcncnnnnnnnnnnnnnnnnnnnnnnnn

SEQ ID NO: 264729 - DNA, 474 bp, Homo sapiens
  misc_feature: GYAE6OF02HQC7X.24.53.E09.1.454.CMB.1.raw
  modified_base (163)..(163): a, c, t, g, unknown or other
  misc_feature (163)..(163): n is a, c, g, or t
  modified_base (288)..(288): a, c, t, g, unknown or other
  misc_feature (288)..(288): n is a, c, g, or t
  modified_base (451)..(474): a, c, t, g, unknown or other
  misc_feature (451)..(474): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagcttccaaaaacngccccccaaatcctcatttatcgtaacaacaatcggccctctggggtccctgaccgattctccgcctccaagtctggcacctcagcctcgctggccatcactggctccaggctgacgatgaggtnattactatcgccagtcgtacgaagatggtcggcggaggactaagctgaccgtcgtaggtcagcccaaggcctgccccctggtcactctcgttcccccaccctcctcaacgattagtacgtctacggaggcccgggctgggaccgaagggcccgacgagtacgnnnnnnnnnnnnnnnnnnnnnnnn

SEQ ID NO: 264730 - DNA, 449 bp, Homo sapiens
  misc_feature: GYAE6OF02HHXOM.24.53.E09.1.454.CMB.1.raw
  modified_base (162)..(162): a, c, t, g, unknown or other
  misc_feature (162)..(162): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
  modified_base (433)..(449): a, c, t, g, unknown or other
  misc_feature (433)..(449): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattctccgcctccaagtctggcacctcagcctcgctggccatcactgggctccaggctggagntgagggtnattactactgccagtcgtacgaagntggttcgggcggagggaactaagctgacccgtctaggtcagcccaaggtctccgcccctcggtcactctcgtccccacctctcacatagtatcngaggcgggctggacaaggcacatagnnnnnnnnnnnnnnnnn

SEQ ID NO: 264731 - DNA, 393 bp, Homo sapiens
  misc_feature: GYAE6OF02JDJSZ.24.53.E09.1.454.CMB.1.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (382)..(393): a, c, t, g, unknown or other
  misc_feature (382)..(393): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtnattacactgccagtcgtcgaagntgttcggcggagggactaagctgaccgtctaggtcagcccaaggctcgccccctcggtcactctcgttccccgcctcctcacatagtagtctggaggcgggctcggacaaggcgacagtagnnnnnnnnnnnn

SEQ ID NO: 264732 - DNA, 588 bp, Homo sapiens
  misc_feature: GYAE6OF02HPEAW.24.53.E09.1.454.CMB.1.raw
  modified_base (348)..(348): a, c, t, g, unknown or other
  misc_feature (348)..(348): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggcttatgttattactgtgcgaccattatcagcacctggagtccgntattctagaactacttccagctaagttcggggaccaggggccacccgtggtccctaccgtcctccctcacgtccctcccaccgaaccggcccacgttccggtcccttccccgtcggcccgcccgtccgcctccgaggcgacctaccgccgaacgcgccaacgacgccggcccgtggccgtcggcccgttaggtccgaacggtacctaccgttaccacgtacgtacgttagtccgtacggg

SEQ ID NO: 264733 - DNA, 677 bp, Homo sapiens
  misc_feature: GYAE6OF02HUSXW.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccgagggacggggctggagtgggtggccaatataaggcacgatggacgtagcatgtactatgtggactctgtgaagggccattcaccatctccagagacaaccgccagaactcactgtatctaggaaatgaccagcctagagagtcgaggacacggctagtagtattactgtgacgtaccatactcagcaccgtggagtcgacatctagaaacttacttccagtctagttcgggggccaggggtcccaacccgtggtaccctaccggttcccttccgtcctacgccctacccgaaacccgaaccgggcccctaacggttccccggttcccctttccccccgtcgggtccccgtaccccgtccggtaccgttccccgaacgggtaccgaccccgtacccgtacccggtaacgaccggaccaaccgaccggccccgggtaccccgtgggtacctccggtcccggttacgggtaaccgaaccggtacccttaccgttaccaaccgtagttaacggttaccgtcgtacggg

SEQ ID NO: 264734 - DNA, 285 bp, Homo sapiens
  misc_feature: GYAE6OF02IHHF7.24.53.E09.1.454.CMB.1.raw
  modified_base (280)..(285): a, c, t, g, unknown or other
  misc_feature (280)..(285): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggtgattactactgccagtcgtcgaagatgttcggcggagggactaagctgaccgtcctaggtcagcccaaggctgccccctcggtcactctcgttcccaccctcctcacatagtagtctgagcgggctggcaaggcgcatagnnnnnn

SEQ ID NO: 264735 - DNA, 283 bp, Homo sapiens
  misc_feature: GYAE6OF02IPWTA.24.53.E09.1.454.CMB.1.raw
  modified_base (279)..(283): a, c, t, g, unknown or other
  misc_feature (279)..(283): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgcccctgtcactctcgtcccaccctcctcacatagtagtctgagcgggctggacaaggcgcatagnnnnn

SEQ ID NO: 264736 - DNA, 558 bp, Homo sapiens
  misc_feature: GYAE6OF02G5XD3.24.53.E09.1.454.CMB.1.raw
  modified_base (163)..(163): a, c, t, g, unknown or other
  misc_feature (163)..(163): n is a, c, g, or t
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (528)..(558): a, c, t, g, unknown or other
  misc_feature (528)..(558): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngacccccaaactcctcatttatcgtaacaacaatcggccctntggggtccctgaccgattctccgcctcaagtctggcacctcagccctcgctggccatcactgggctccgaggctgaggatggagggtgtattactacngccaggtcgtcgaagnttggtcggcgggtaaggactaacgctacggacccgtacgtaggtccacggtcccgaaggcctccgccccccgttacggtccacccgttccgttcccgttacccccacccccttcctacccgtaaaccgtacgttacggttaccgtttccgtacgggtacggggtcccggggtacggtacgggacgtaagggccgacgacgtagcagtcnnnnnnnnnnnnnnnnnnnnnnnnnnnnnnn

SEQ ID NO: 264737 - DNA, 293 bp, Homo sapiens
  misc_feature: GYAE6OF02G5IMM.24.53.E09.1.454.CMB.1.raw
  modified_base (140)..(140): a, c, t, g, unknown or other
  misc_feature (140)..(140): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (279)..(293): a, c, t, g, unknown or other
  misc_feature (279)..(293): n is a, c, g, or t
tcagactactatgtcacgaccggtgctcgatttagagagagtgtgttgggtttgggggtgtggtggtctccactcccgccttgaccgggctgctatctgcctcgctggccatcactgggctccaggctgaggatgaggtnattactactgccagtcgtcgaagatgttcggcggagggactaagctgaccgtctaggtcagcccaaggctgcccccctggtcactctcgttccccgccctcctnacatagtatctgagcggtctggcaaggcncatagnnnnnnnnnnnnnnn

SEQ ID NO: 264738 - DNA, 282 bp, Homo sapiens
  misc_feature: GYAE6OF02I60G4.24.53.E09.1.454.CMB.1.raw
  modified_base (244)..(244): a, c, t, g, unknown or other
  misc_feature (244)..(244): n is a, c, g, or t
  modified_base (281)..(282): a, c, t, g, unknown or other
  misc_feature (281)..(282): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttccccaccctccncacatagtagtctgagcgggctggcaaggcgcatagnn

SEQ ID NO: 264739 - DNA, 474 bp, Homo sapiens
  misc_feature: GYAE6OF02IND9Y.24.53.E09.1.454.CMB.1.raw
  modified_base (161)..(161): a, c, t, g, unknown or other
  misc_feature (161)..(161): n is a, c, g, or t
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (411)..(411): a, c, t, g, unknown or other
  misc_feature (411)..(411): n is a, c, g, or t
  modified_base (450)..(474): a, c, t, g, unknown or other
  misc_feature (450)..(474): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngccccccaaatcctacattttatcgtaacaacaatcggccctctggggtccctgaccgattctccgctcagtctggcacctnagcctgctggccatcgcgtggctccaggcctggaggatcgaggggtntattcctactggcccagtcgtcgaagatggttcgggcggagggactaaagctgaccggttctaggtccagcccaaggcctacgcccccgtggtccacgtcttcgtccccgccctcctaccncatagtacgtcgtgagcgggcgtggtcgacgcgcatagnnnnnnnnnnnnnnnnnnnnnnnnn

SEQ ID NO: 264740 - DNA, 287 bp, Homo sapiens
  misc_feature: GYAE6OF02FGU8W.24.53.E09.1.454.CMB.1.raw
  modified_base (280)..(287): a, c, t, g, unknown or other
  misc_feature (280)..(287): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgccccctggtcactctgttccccaccctcctcacatagtagtctgagcgggctggcaaggcgcatagnnnnnnnn

SEQ ID NO: 264741 - DNA, 475 bp, Homo sapiens
  misc_feature: GYAE6OF02HJ7QS.24.53.E09.1.454.CMB.1.raw
  modified_base (452)..(475): a, c, t, g, unknown or other
  misc_feature (452)..(475): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacagcccccaaaactcctcattttatcgtaacaacaatcggccctctggggtccctgaccgattctccgcctccaagtctggcacctcagcctcgctggccatcactgggctccaggctgaggatgagggtgattactactgccaggtcgttcggaaagtactggttccgggcggagggactaagctgaccgtctaggtcagcccaaggctcgcccctggtccactctcgtccccacctcctcgactatagtgtctcgacgcgggtcctggacgaaggtccgacagttagcnnnnnnnnnnnnnnnnnnnnnnnn

SEQ ID NO: 264742 - DNA, 498 bp, Homo sapiens
  misc_feature: GYAE6OF02GWNVR.24.53.E09.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
  modified_base (465)..(498): a, c, t, g, unknown or other
  misc_feature (465)..(498): n is a, c, g, or t
tcagactactatgtcacgaccggtgctcgatttagagagagtgtgttggggtttgggggctgtttttggagctgcttgtaccagagggtcaccatctcctgcactgggagcaacatcggcgcaggttttgatgtccactggtacaagcagcttaccaaaaacncgccccccaaactcctcatttancgtaacaacaatcggccctctggggtccctgaccgattcnccgcctccaagtctggcacctcacncctcgctcggccatcacgtgggcctccgaggctggaggatggagggtnattactactgccagtcgtacgaagnttggtcggnggaggactaagctgaccgtcaggtcacgcccaaggcctccgcccgtgtcacgtctccgttccccnccctcgtaccactagtacgtacgtctaggagtccgggcgtacgggactaacgggcgactaagtacgnnnnnnnnnnnnnnnnnnnnnnnnnnnnnnnnnn

SEQ ID NO: 264743 - DNA, 682 bp, Homo sapiens
  misc_feature: GYAE6OF02J3XNH.24.53.E09.1.454.CMB.1.raw
  modified_base (154)..(154): a, c, t, g, unknown or other
  misc_feature (154)..(154): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (493)..(493): a, c, t, g, unknown or other
  misc_feature (493)..(493): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (615)..(615): a, c, t, g, unknown or other
  misc_feature (615)..(615): n is a, c, g, or t
tcagactactatgtcacgaccggtgctcgatttagagagagtgtgttgggtttgggaggcttggtccagcctgggggtccctgagactctcctgtgccagcctcgtggactttccccgtttagtgtactttttggatcgaccgttcgggtcccnccgaggtcctaccgaaggggccgggtctagggtagtcgggtacgacctaaagtacgtaacggccacggtagtcggaaccgtagcctaagttcgttaaccgtagtcggtacggaccttcggtaggtacggaaccggtccctaattcccaccgtacttccgaccgagaccgaacctacccgacccgaacgtaaccttcgaccgtttagtaactccggtaaaggtaactccgaaaccgcgtacgtaagacggtacgtacgtaccgacgtcggtactaggtacgtctacgngtacgactangtacncgcgtactcgtaggactcgatatctacgactccacgngtacgtacggccggactcgaccctgtcgaccnccgtacncgactcgccgtaccgacgtccgcctcgtccgtacccgttcgccgactccgtcgacgcgacgtccgacctcgacgacgccgacncgcggcctcgcgtacgccgtcgaaccgtacggtacctaccgttcgactagtcgacggtcgacgtcgg

SEQ ID NO: 264744 - DNA, 476 bp, Homo sapiens
  misc_feature: GYAE6OF02GCQ5V.24.53.E09.1.454.CMB.1.raw
  modified_base (164)..(164): a, c, t, g, unknown or other
  misc_feature (164)..(164): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (457)..(476): a, c, t, g, unknown or other
  misc_feature (457)..(476): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacngccccccaaactcctcatttatcgtaacaacaatcggccctcgtcggggtccctgaccgtattcctccgcctccaagtctggcacctcacgcctcgctggccatcactgggctccaggcctgaggatgagggtnattactactgccaggtcgtcgaagnttggttcggcgggaggactaagctcgccgtctaggtcacgcccaaggcctacgcccccgtggtcacttctccgttccccaccccttcctcacattacgtagtctggacgcgggctgggcaaggccgcacgtagnnnnnnnnnnnnnnnnnnnn

SEQ ID NO: 264745 - DNA, 622 bp, Homo sapiens
  misc_feature: GYAE6OF02H6EPB.24.53.E09.1.454.CMB.1.raw
  modified_base (232)..(232): a, c, t, g, unknown or other
  misc_feature (232)..(232): n is a, c, g, or t
  modified_base (545)..(545): a, c, t, g, unknown or other
  misc_feature (545)..(545): n is a, c, g, or t
  modified_base (554)..(555): a, c, t, g, unknown or other
  misc_feature (554)..(555): n is a, c, g, or t
  modified_base (557)..(558): a, c, t, g, unknown or other
  misc_feature (557)..(558): n is a, c, g, or t
  modified_base (561)..(561): a, c, t, g, unknown or other
  misc_feature (561)..(561): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
tcagactactatgtcacgaccggtgctcgatttagagagagtgtgttgggtttgggggctgtttttggaagctgcttgtaccagagggtcaccatctcctgcactgggaacaacatcggcgcaggtttttgatgtccactggtacaagcagcttaccaaaaaacacgcccccaaaactcctacatttatacgtaacaaacaatccgaccctcgtgggtccctgaccgattcnccgcctaccaagtctggcacctcagcctcgctgccatccactggctccaggctgaggataggaggtgaacttactacgtcgaccagttaccggtacgaaaagtcgtacggtttccgggacggtaagggaactaaacggcgttaacggaacccggttaccgtaagggttccgaacggaccccgaaagggttcctacgccccccgtacgggtccaccgttcttccgtttaccccaccctcccgtacaactagtacgttagtccgtcggtaacggccgggtctacgggaccgaacgggtacccgactaacgtacgntacgcagtnnanncanacacgacgtactagtacacgcgcgtatacacgngngtanaganacacgnacgnagntcanc

SEQ ID NO: 264746 - DNA, 687 bp, Homo sapiens
  misc_feature: GYAE6OF02G7Y7S.24.53.E09.1.454.CMB.1.raw
  modified_base (308)..(308): a, c, t, g, unknown or other
  misc_feature (308)..(308): n is a, c, g, or t
tcagactactatgtcacgaccggtgctcgatttagagagagtgtgttgggtttgggaggcttggtccagcctggggggtccctgagactctcctgtgcagcctctggattcccctttagtgtactttttggatgacctgggtccgccaggctccgagggacggggctggagtgggtggccaatataaggcacgatggacgtagcatgtactatgtggactctgtgaagggccgattcaccatctccagacgacaacgcccagaactcactgtatctaggaaatcgaccagcctagagagtcgaggacncggctatgtatacgtgtgacgacatatcagacaccgtgaacgtcgacatctagtaactaccttcgagctaggttcggggcccagggaccctacccgtcggtaccctcccgttaccttcccgtcgtaccgtcccgtaccgaacccgaaccgggacccctacggttcccggttccccgttcccccgtcggtaccccgtcccgtccgtccccgtaccgaccggaccgacccgtaccgacccggagtaccgacgcccgaacgggtccccgggtacccgtccggggaccgtccggtacccggttaccgggtaaccgtaaacgggttacccttaacccgttacccgtaaccgtacgtttaacggttaaccggttcggtaaccggg

SEQ ID NO: 264747 - DNA, 289 bp, Homo sapiens
  misc_feature: GYAE6OF02GKHFB.24.53.E09.1.454.CMB.1.raw
  modified_base (283)..(289): a, c, t, g, unknown or other
  misc_feature (283)..(289): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatagnnnnnnn

SEQ ID NO: 264748 - DNA, 290 bp, Homo sapiens
  misc_feature: GYAE6OF02HI22S.24.53.E09.1.454.CMB.1.raw
  modified_base (283)..(290): a, c, t, g, unknown or other
  misc_feature (283)..(290): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatagnnnnnnnn

SEQ ID NO: 264749 - DNA, 308 bp, Homo sapiens
  misc_feature: GYAE6OF02GFAOG.24.53.E09.1.454.CMB.1.raw
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (298)..(308): a, c, t, g, unknown or other
  misc_feature (298)..(308): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggacgaggctgactattattgcagttcatggacaagcagcagcttccggctcttcggaagtgggaccaaggtcaccgtcctcggtcagcccaaggcccaaccccactgtcactctgttccccgcctcctcaacatagtagtcngagccgggctggcaaggcncatagnnnnnnnnnnn

SEQ ID NO: 264750 - DNA, 439 bp, Homo sapiens
  misc_feature: GYAE6OF02FJ4NL.24.53.E09.1.454.CMB.1.raw
  modified_base (428)..(439): a, c, t, g, unknown or other
  misc_feature (428)..(439): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccaccaaactcctcatttatcgtaacaacaatcggccctctggggtccctgaccgattctccgcctccaagtctggcacctcagcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctgagcgggctggcaaggcgcatagnnnnnnnnnnnn

SEQ ID NO: 264751 - DNA, 501 bp, Homo sapiens
  misc_feature: GYAE6OF02JCGQY.24.53.E09.1.454.CMB.1.raw
  modified_base (343)..(343): a, c, t, g, unknown or other
  misc_feature (343)..(343): n is a, c, g, or t
  modified_base (476)..(476): a, c, t, g, unknown or other
  misc_feature (476)..(476): n is a, c, g, or t
  modified_base (478)..(501): a, c, t, g, unknown or other
  misc_feature (478)..(501): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaaactccctcatttatcgtaacaacaatcggccctctggggtccctgaccgattcctccgcctccaagtctggctacctcacgccctcgcctcggcccatccacgtgggcctccgaggctggacggatggagggtgtattactactgcctagtcgtacgaagtatggtcggngggaggactaagcgtcgtaccgtccgtaggtcacgcccaagggcctcgccccctggtccacgtctccgttccccgccctcctccactagtacgtacgtcttaggacggcgggtcgtcggacgaggccgactgngnnnnnnnnnnnnnnnnnnnnnnnn

SEQ ID NO: 264752 - DNA, 376 bp, Homo sapiens
  misc_feature: GYAE6OF02GG686.24.53.E09.1.454.CMB.1.raw
  modified_base (270)..(270): a, c, t, g, unknown or other
  misc_feature (270)..(270): n is a, c, g, or t
  modified_base (289)..(291): a, c, t, g, unknown or other
  misc_feature (289)..(291): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (300)..(376): a, c, t, g, unknown or other
  misc_feature (300)..(376): n is a, c, g, or t
tcagactactatgtcacgaccggtgctcgatttagagagagtgtgttggggtttgggggggtgtggtggtctccactcccgccttgacggggctgctatctgcctcgctggccatcactggctccaggctgaggatgagggttgattactactgccagtcgtcgaaagatgttcggcggagggacctaagctgaccgtcctaggtcagcccaaaggctcgcccccctggtcactctgttccccgccctctcacatagtatctgagcgggntggacaaggtcgcaatagnnngangntacnnnnnnnnnnnnnnnnnnnnnnnnnnnnnnnnnnnnnnnnnnnnnnnnnnnnnnnnnnnnnnnnnnnnnnnnnnnnn

SEQ ID NO: 264753 - DNA, 453 bp, Homo sapiens
  misc_feature: GYAE6OF02F487Q.24.53.E09.1.454.CMB.1.raw
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (404)..(405): a, c, t, g, unknown or other
  misc_feature (404)..(405): n is a, c, g, or t
  modified_base (408)..(408): a, c, t, g, unknown or other
  misc_feature (408)..(408): n is a, c, g, or t
  modified_base (410)..(453): a, c, t, g, unknown or other
  misc_feature (410)..(453): n is a, c, g, or t
tcagactactatgtcacgaccggtgctcgatttagagagagtgtgttgggtttgggagcaacatcggcgcaggttttgatgtccactggtacaagcagcttccaaaaaacagcccccaaactcctcatttatcgtaacaacaatcggcccctctggggtcccctgaccgattctccgcctccaagtctggcacctcagcctcgctggccatcactgggctccaggctgaggatgagggtgattacactgccagtcgtcgaagagtgttcggcggaggactaagctgaccgtcctaggtcacgcccaaggctcgccccctggtccactctcgttccccgccctccncacagtactgtctgagccgggtntcggcgaacgggtcncaagttagctagctgctcganncgncnnnnnnnnnnnnnnnnnnnnnnnnnnnnnnnnnnnnnnnnnnnn

SEQ ID NO: 264754 - DNA, 474 bp, Homo sapiens
  misc_feature: GYAE6OF02IITEB.24.53.E09.1.454.CMB.1.raw
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (412)..(412): a, c, t, g, unknown or other
  misc_feature (412)..(412): n is a, c, g, or t
  modified_base (444)..(445): a, c, t, g, unknown or other
  misc_feature (444)..(445): n is a, c, g, or t
  modified_base (448)..(474): a, c, t, g, unknown or other
  misc_feature (448)..(474): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattcctccgcctccaagtctggcacctcagcctcgctggccatcactggctccaggctgagntggaggtnattactactgccagtcgtcgaagatggttcggcggaggactaagctcgaccgtcgtagtcacgcccgaaggctccgcccctggtcacttctcgttccccaaccctcctccaacatagtagtcnggacggcgggctaggccgaaggccgacagtanncannnnnnnnnnnnnnnnnnnnnnnnnnn

SEQ ID NO: 264755 - DNA, 286 bp, Homo sapiens
  misc_feature: GYAE6OF02JALOR.24.53.E09.1.454.CMB.1.raw
  modified_base (281)..(286): a, c, t, g, unknown or other
  misc_feature (281)..(286): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccgccctcctcacatagtagtctgagcgggctggcaaggcgcatagnnnnnn

SEQ ID NO: 264756 - DNA, 467 bp, Homo sapiens
  misc_feature: GYAE6OF02F6RV8.24.53.E09.1.454.CMB.1.raw
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (435)..(441): a, c, t, g, unknown or other
  misc_feature (435)..(441): n is a, c, g, or t
  modified_base (443)..(443): a, c, t, g, unknown or other
  misc_feature (443)..(443): n is a, c, g, or t
  modified_base (445)..(467): a, c, t, g, unknown or other
  misc_feature (445)..(467): n is a, c, g, or t
tcagactactatgtcacgaccggtgctcgatttagagagagtgtgttgggtttgggggctgtttttggaagctgcttgtaccagagggtcaccatctcctgcactggggagcaacatcggcgcaggttttgatgtccactggtacaagcagcttccaaaaacagcccccaaatcctcatttancgtaacaacaatcggccctntggggtccctgaccgattctccgcctccaagtctggcacctcagcctcgctggccatcactgggctccgaggctgaggatggagggtgattactactgccagtcgtcgaagagttggtcggcggagggactaagctgaccgtctaggtcagcccaaggcctcgcccctgcactctcgtccccaccctctcacatagtagtctgagcgggtctggacaacggccgacagtagnnnnnnncngnnnnnnnnnnnnnnnnnnnnnnn

SEQ ID NO: 264757 - DNA, 518 bp, Homo sapiens
  misc_feature: GYAE6OF02FMY1W.24.53.E09.1.454.CMB.1.raw
  modified_base (478)..(478): a, c, t, g, unknown or other
  misc_feature (478)..(478): n is a, c, g, or t
  modified_base (488)..(503): a, c, t, g, unknown or other
  misc_feature (488)..(503): n is a, c, g, or t
  modified_base (505)..(518): a, c, t, g, unknown or other
  misc_feature (505)..(518): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatccggccctctggggtccctgaccgattctccgcctccaagtctggcacctcagcctcgctggccatcactgggctccgaggctgaggatgagggtgattactactgccagtcgtcgaagatgttcggcggaggactaagctgaccgtcctaggtcacgcccaaggctccgcccccgtggtccactccgtcgttacccccacccttcccgtaccaactactaacggttacgtccgtaggacgggccgggtcgtggccgaaacgggcccggactaagttaaggntgagtcagcnnnnnnnnnnnnnnnngnnnnnnnnnnnnnn

SEQ ID NO: 264758 - DNA, 682 bp, Homo sapiens
  misc_feature: GYAE6OF02GRXHA.24.53.E09.1.454.CMB.1.raw
  modified_base (163)..(163): a, c, t, g, unknown or other
  misc_feature (163)..(163): n is a, c, g, or t
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (576)..(576): a, c, t, g, unknown or other
  misc_feature (576)..(576): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccgaaaaacngacccccaaatcctcatttatcgtaaacacaatcggccctntcgggtccctgaccgattcnccgctccaagtctgcacctnagcctcgactggccatcactggcctaccaggctgagtatggtaggtnattactacgtgaccgtagtcgtacgaaagagttcggttacggacggtaaggtaacttaacggcgttacggtacccgttaccgtaacggtacaaccgtaccccgaaagggtcccctaccgggtaccccccgttacgggttacctaaacccgtttccgtttacccggttacccccctaacccccgtttccctacctaaaccgtaacgtttaacggttacggtaccgttacgggaacgggtccgggtacgtacggggtaacgaaacgggtccgacgtaagttaacggngtacgtgcgtactacgctagcgtagtacgacgacgtacgtcgtacgtcgtacgtacgtacgagacgtagtacgacgacgtacagacgtacgacgagactacgatcg

SEQ ID NO: 264759 - DNA, 649 bp, Homo sapiens
  misc_feature: GYAE6OF02F8SGN.24.53.E09.1.454.CMB.1.raw
  modified_base (291)..(291): a, c, t, g, unknown or other
  misc_feature (291)..(291): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (626)..(627): a, c, t, g, unknown or other
  misc_feature (626)..(627): n is a, c, g, or t
  modified_base (629)..(630): a, c, t, g, unknown or other
  misc_feature (629)..(630): n is a, c, g, or t
  modified_base (632)..(636): a, c, t, g, unknown or other
  misc_feature (632)..(636): n is a, c, g, or t
  modified_base (638)..(647): a, c, t, g, unknown or other
  misc_feature (638)..(647): n is a, c, g, or t
  modified_base (649)..(649): a, c, t, g, unknown or other
  misc_feature (649)..(649): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacacgcccccaaaactcctcatttatcgtaacaacaatcggccctctggggtccctgaccgattctccgcctccaagtctggcacctcagcctcgctggccatcactgggcctcaggctgaggatgagggtnattactactcgcctagtcgtacggaagtagttggttcggggacgggaaggggtaactaaaggtccgtacggtaaacccggttccgttaaacgggtccaaacgggaccccgtaaaagggggtccccttacccgggtcccccccgttcggggttacctaaccccgtttccgtttacccggttttacccccccaacccccttttaccccgtaccgtaacctaacgttaacggttaaccggtttaccgttaacggaccggggtccggggtacccgttacggggaccgaaaacggggtccgtaccgtaagtaacggcncgacgancnncnanagngngcnngnncnnnnncnnnnnnnnnnan

SEQ ID NO: 264760 - DNA, 488 bp, Homo sapiens
  misc_feature: GYAE6OF02I7JG4.24.53.E09.1.454.CMB.1.raw
  modified_base (163)..(163): a, c, t, g, unknown or other
  misc_feature (163)..(163): n is a, c, g, or t
  modified_base (184)..(184): a, c, t, g, unknown or other
  misc_feature (184)..(184): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (455)..(482): a, c, t, g, unknown or other
  misc_feature (455)..(482): n is a, c, g, or t
  modified_base (484)..(488): a, c, t, g, unknown or other
  misc_feature (484)..(488): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcacccaaactcctcatttancgtaacaacaatcggccctcgtcggggtccctgaccgattcctcccgcctccaagtctggccacctcagcctcgctcggcctatccacgtcgggcctccgagggcctggaggatggaggggtntaattactactgcctaggtcgtacgaagtntggtcggaggaggactagctgccgtcgtagcacgccaggcnccgcccctggcnctctccgttcccncctcacacntagtctctcggagcgggctacggacaacgggccacgagtacgnnnnnnnnnnnnnnnnnnnnnnnnnnnncnnnnn

SEQ ID NO: 264761 - DNA, 472 bp, Homo sapiens
  misc_feature: GYAE6OF02G32RA.24.53.E09.1.454.CMB.1.raw
  modified_base (161)..(161): a, c, t, g, unknown or other
  misc_feature (161)..(161): n is a, c, g, or t
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (442)..(472): a, c, t, g, unknown or other
  misc_feature (442)..(472): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaatcctcatttatcgtaacaacaatcggccctctggggtccctgaccgattcnccgcctccaagtctggcacctcagcctcgctggccatcactgggctccgagctgagatgagggtnattacntgccaggtcgcgaagngtcggtcggacggagggactaaggctaggacccgtcgtaggccacgcccaaggctccgcccctggcnctctcgtccccncctcncacatagtacgtctagacggcgggtcgtcggacgaggtccgactagtagnnnnnnnnnnnnnnnnnnnnnnnnnnnnnnn

SEQ ID NO: 264762 - DNA, 292 bp, Homo sapiens
  misc_feature: GYAE6OF02G8SA7.24.53.E09.1.454.CMB.1.raw
  modified_base (286)..(292): a, c, t, g, unknown or other
  misc_feature (286)..(292): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgcccctcggtcactctcgttcccaccctcctacacatagtagtctgaggcgggctggacaaggtcgacatagnnnnnnn

SEQ ID NO: 264763 - DNA, 291 bp, Homo sapiens
  misc_feature: GYAE6OF02F75U1.24.53.E09.1.454.CMB.1.raw
  modified_base (284)..(291): a, c, t, g, unknown or other
  misc_feature (284)..(291): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcacgccaaggctcgccccctggtcactctcgttccccaccctcctcacatagtacgtctggagcgggctggcaaggcgcatagnnnnnnnn

SEQ ID NO: 264764 - DNA, 930 bp, Homo sapiens
  misc_feature: GYAE6OF02FTDTF.24.53.E09.1.454.CMB.1.raw
tcagactactatgtcacgaccggtgctcgatttagagagagtgtgttgggtttggggaggcttggtccagcctggggggtccctgagactctcctgtgcagcctctggattcccctttagtgacttttggatgacctgggtccgccaggctccagggacgggctggagtgggtggccaatagtaaggcacgatggacgtagcatgtactatgtggactcgtgtagaacgggccgattccacctatcctaccagacgaccaacgccaagaacctcaaccttgtaatccgtaggaaatcggaacctagccgttaggagacggttccgagggtaacctacgggtacttaagtcggttaactttacgtcggtaggtacccgactacgttactccgaacgtcctaaaccggtggtaacggtccgacgttaacgttccgtaaggtaaactttacccggttcccgaaaggggttccttaacggggtttaccgggggaccttaacgggggtacccttaccccggttacgggttacccgtacccggtttccgtaccccgttacggtaacccgtcccgttaacccgtaacccgggtaaccgggttccccgtaacggtttaccccgggtttaccccgttttaaccccccgggtgggttacccccggttaccccggtttacgggttaccccgttaaccccgggtacggggttaaccccgttacccggttaaaccccgggttacccggggtaaacgttaacccgggtaccgttaaacccgggttaaccggggcccggttttaaccccggtcgggggttacccgtttccgggttaccccggtttacgggtaacccggttaaaaccggttacccgtttttaacccggtacccggttaaacgttaaccggtttaaccgggttaccggtttccgggttaaaccgggg

SEQ ID NO: 264765 - DNA, 758 bp, Homo sapiens
  misc_feature: GYAE6OF02G37QO.24.53.E09.1.454.CMB.1.raw
  modified_base (241)..(241): a, c, t, g, unknown or other
  misc_feature (241)..(241): n is a, c, g, or t
tcagactactatgtcacgaccggtgctcgatttagagagagtgtgttgggtttgggaggcttggtccagcctggggggtccctgagactctcctgtgcagcctctggattcccctttagtgtacttttggatgacctgggtccgccaggctccgagggcgggctggagtgggtggccaatataaggcacgagtggacgtagcatgtactatggtggactctgtgaggccgattcaccatcncagagacacgcccagactcactgtatcgtaggaaatcgaccagcctgagagtcgaggacgacggtctagtagttacttcgtgtcgcgtaaccataatcgagccaccgtggacgtcgactatcgtagtaacttacttaccgagtcctacggttcggggacccgtaacggggccctacccggttggtccccgtacccggttacccttccccgtaccgtaccggtccctacccgaacccgaaccgggtaccccgtacggttcccggttcccctttaccccccgtcgggtccccgtccccgtaccggtcccgttacccgaccgggtaccgacccgtaaccccggtacccgaacgtaccggacccgaaaccggtcccgggaaccccggggtcccccggttacggggtcccgttacccggggtaccccggtttacggggtaaccccgtaaaccggggttaccctttaacccggtttacccaaacccgttacgtttaaccggttacgttcccgggtaaccgggg

SEQ ID NO: 264766 - DNA, 288 bp, Homo sapiens
  misc_feature: GYAE6OF02G49WH.24.53.E09.1.454.CMB.1.raw
  modified_base (281)..(288): a, c, t, g, unknown or other
  misc_feature (281)..(288): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttccggcggagggactaagctgaccgtcctaggtcagcccaaggctgcccccctggtcactctgttccccaccctcctcacatagtagtctgagcgggtctggcaaggcgcatgnnnnnnnn

SEQ ID NO: 264767 - DNA, 522 bp, Homo sapiens
  misc_feature: GYAE6OF02J157D.24.53.E09.1.454.CMB.1.raw
  modified_base (163)..(163): a, c, t, g, unknown or other
  misc_feature (163)..(163): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (486)..(487): a, c, t, g, unknown or other
  misc_feature (486)..(487): n is a, c, g, or t
  modified_base (489)..(492): a, c, t, g, unknown or other
  misc_feature (489)..(492): n is a, c, g, or t
  modified_base (494)..(522): a, c, t, g, unknown or other
  misc_feature (494)..(522): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaactcctcatttatcgtaacaacaatcggccctctggggtccctgaccgattctccgcctcaagtctggcacctcagcctcgctggccatcactggctccaggctggagntgagggtnacttactactggcccaggtcctacgaagtattcggttcggcgggaacggtactaacggcttcggaccgttcctagggtccacgcccaaggcctccgccccgtaggtcacttctccgtccccacccgtcctcgactacttagttacgtccgttaggaacgggtccgggtctagggaccctaaggggccgactagtagcnncnnnngnnnnnnnnnnnnnnnnnnnnnnnnnnnnn

SEQ ID NO: 264768 - DNA, 455 bp, Homo sapiens
  misc_feature: GYAE6OF02JER4O.24.53.E09.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (432)..(455): a, c, t, g, unknown or other
  misc_feature (432)..(455): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatccggccctntggggtccctgaccgattctccgcctccaagtctggcacctcagcctcgctggccatcactgggctccaggctgaggatgagggtnattactctgccagtcgtcgaagatgttcgggcggagggactaagctgaccgtcctaggtcagcccaaggcctcgccccctggcactctcgttccccacccttcncacatatagtctgagccgggctggcaaggcncatagnnnnnnnnnnnnnnnnnnnnnnnn

SEQ ID NO: 264769 - DNA, 485 bp, Homo sapiens
  misc_feature: GYAE6OF02GVB14.24.53.E09.1.454.CMB.1.raw
  modified_base (162)..(162): a, c, t, g, unknown or other
  misc_feature (162)..(162): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (455)..(455): a, c, t, g, unknown or other
  misc_feature (455)..(455): n is a, c, g, or t
  modified_base (457)..(485): a, c, t, g, unknown or other
  misc_feature (457)..(485): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacngccccccaaatcctcatttatcgtaacaacaatcggccctctggggtccctgaccgattctccgcctccaagtctggccacctcagcctcgctggccatcactggctccaggctgaggntggagggtntattactactgcctagtcgtacgaagatggtcggnggagggactaagctgacccgtctaggcagcccaggctccgcccctggtcacgtctccgttccccacccgtctaccactacgtacgtacgtcgtggacggcgggtcgtcggacgaacgggcgacgaagtgngnnnnnnnnnnnnnnnnnnnnnnnnnnnnn

SEQ ID NO: 264770 - DNA, 289 bp, Homo sapiens
  misc_feature: GYAE6OF02HEWWU.24.53.E09.1.454.CMB.1.raw
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (282)..(289): a, c, t, g, unknown or other
  misc_feature (282)..(289): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctagcacgccaggctcgcccctggtcactctcgttccccaccctctacactatagtntctaggcgcgggctggcgaaggccgnatgnnnnnnnn

SEQ ID NO: 264771 - DNA, 636 bp, Homo sapiens
  misc_feature: GYAE6OF02GLH9O.24.53.E09.1.454.CMB.1.raw
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagactactatgtcacgaccggtgctcgatttagagagagtgtgttggggtttgggggggtgtggtggtcctccactcccgccttgacgggctgctatctgccgtcgctggccatcacgtggcctccgaggctgaggatggagggtgtacttactactggccagtcgtacgaaagtatcggttcggcggaggactaacgcctggacctcctagtcacgtcccaaggcctcgccccctggtccactctcgttccccnccctccgtcactagtagtactctggacggtccggtcttacggacgaacggtcgtacaagtagnacgacgnggacngtacctgacgntacgtgtactcgtgtaagctaacctatggacttacgacgtggtacgtcaacggtcacgtacgtggcaagtcgactgtcagggaacctttagcgtacgtaccgtctacggactacgtacctaggttctaacggactacgacgttacgacgttccgaggtactaaggtcttaacctgttaacctcgtaacgtcgttaacctcgtaattcctaacgtccgtacgtcgtaaaacggttccgacggtacggtacgacggtagtaccgacggttacgacgtacggtcgccgtacgaccg

SEQ ID NO: 264772 - DNA, 600 bp, Homo sapiens
  misc_feature: GYAE6OF02HQ0MV.24.53.E09.1.454.CMB.1.raw
  modified_base (165)..(165): a, c, t, g, unknown or other
  misc_feature (165)..(165): n is a, c, g, or t
  modified_base (188)..(188): a, c, t, g, unknown or other
  misc_feature (188)..(188): n is a, c, g, or t
  modified_base (320)..(320): a, c, t, g, unknown or other
  misc_feature (320)..(320): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (570)..(573): a, c, t, g, unknown or other
  misc_feature (570)..(573): n is a, c, g, or t
  modified_base (575)..(578): a, c, t, g, unknown or other
  misc_feature (575)..(578): n is a, c, g, or t
  modified_base (580)..(582): a, c, t, g, unknown or other
  misc_feature (580)..(582): n is a, c, g, or t
  modified_base (584)..(588): a, c, t, g, unknown or other
  misc_feature (584)..(588): n is a, c, g, or t
  modified_base (590)..(591): a, c, t, g, unknown or other
  misc_feature (590)..(591): n is a, c, g, or t
  modified_base (593)..(596): a, c, t, g, unknown or other
  misc_feature (593)..(596): n is a, c, g, or t
  modified_base (598)..(599): a, c, t, g, unknown or other
  misc_feature (598)..(599): n is a, c, g, or t
tcagactactatgtcacgaccggtgctcgatttagagagagtgtgttgggtttgggggcttgttttggaagctgcttgtaccagagggtcaccatctcctgcactgggagcaaacatcggcgctaggttttgatgtccactggtacaagctagcttacaaaaacncgcccccaaactcctcatttacncgtaaacaacaatccggccctcgttgggggtcccctgaccgtattccgtcccgccttccaaagttctcggccacctcacgcccttcgcgtcggcccaattccacggtcgggcctccgagggtcctgaacggngtgtaggggttacttacgtactcgcgtacgtcggtacgaaacgtgttacggtccgggaacgggaggttaaccaaggtcgttaccggtacccgtacgttacggtccaggacctacgggtctcccggaccccctgggtcctactccgttcgggtccccctccgtcccttacgaccttaagttcgtacgtcgttaggacggccgggtagtcgggtacgaacggctcgtagtaccgtnagtcatgatncgngcnnnncnnnntnnngnnnnncnngnnnngnng

SEQ ID NO: 264773 - DNA, 394 bp, Homo sapiens
  misc_feature: GYAE6OF02GHNYY.24.53.E09.1.454.CMB.1.raw
  modified_base (380)..(380): a, c, t, g, unknown or other
  misc_feature (380)..(380): n is a, c, g, or t
  modified_base (385)..(394): a, c, t, g, unknown or other
  misc_feature (385)..(394): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatgagggtgattactactgccagtcgtacgaagtatggttcggcggagggactaagctgaccgtcctaggtcacgcccaaggcctcgccccctcggtcactctcgttccccgccctcctcacatagtagtctgacgcgggctggcaaggcgnatagnnnnnnnnnn

SEQ ID NO: 264774 - DNA, 562 bp, Homo sapiens
  misc_feature: GYAE6OF02HR6RM.24.53.E09.1.454.CMB.1.raw
  modified_base (249)..(249): a, c, t, g, unknown or other
  misc_feature (249)..(249): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (479)..(479): a, c, t, g, unknown or other
  misc_feature (479)..(479): n is a, c, g, or t
tcagactactatgtcacgaccggtgctcgatttagagagagtgtgttgggtttggggaggcttggtccagcctggggggtccctgagactctcctgtgcagcctctggattcccctttagtgtactttttggatgacctgggtccgccaggctccaggggacggggctggagtgggtggccaatataaggcacgatggacgtagcatgtactatgtggactctgtgaaggccattcaccatctccaganacaacgcccagaactcactgtatctaggaaatgaccagcctgagagtcgaggacacggctatgtaattactgtgcgaccatatcagtcaccgtggacgtcgactatctagaaacttacttcccagtcagttggggccaagggcctacccgtggtaccaccgtctcctcacgtcctacccgaacgacgggcccagtccgtccctccccgngccnccctcgctaccgaggcnccacctccgagacgcacgacgccgccgtggcctcgccgtggtacaacggtactacgttaccgaatagtaacgtacgtgtacgg

SEQ ID NO: 264775 - DNA, 535 bp, Homo sapiens
  misc_feature: GYAE6OF02I7FQ5.24.53.E09.1.454.CMB.1.raw
  modified_base (162)..(162): a, c, t, g, unknown or other
  misc_feature (162)..(162): n is a, c, g, or t
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (500)..(502): a, c, t, g, unknown or other
  misc_feature (500)..(502): n is a, c, g, or t
  modified_base (504)..(504): a, c, t, g, unknown or other
  misc_feature (504)..(504): n is a, c, g, or t
  modified_base (506)..(508): a, c, t, g, unknown or other
  misc_feature (506)..(508): n is a, c, g, or t
  modified_base (510)..(517): a, c, t, g, unknown or other
  misc_feature (510)..(517): n is a, c, g, or t
  modified_base (519)..(535): a, c, t, g, unknown or other
  misc_feature (519)..(535): n is a, c, g, or t
tcagactactatgtcacgaccggtgctcgatttagagagagtgtgttgggtttgggggctgtttttggaagctgcttgtaccagagggtcaccatctcccgcactgggagcaacatcggcgcaggttttgatgtccactggtacaagcagcttccaaaaacngccccccaaactcctcatttatcgtaaacaacaatcggccctctggggtccctgaccgattcctccgcctccaagtctggcacctnatcctcgctggccatcactgggctccaggctgagatgagggtnattacactgaccagtccggtcgaagattggttacggcgggaaggtctaaagcgtcgaaccgtccgtaaggtcacgcccgaagggcttccggcccccttgggtcaaccgtcttcggttcccccgcccttcctacaacgtaacgttacgttacgtcttacgacggcgggtcccagggtaccgaaacgggccgtacagttacggnacgntcnnngncnnncnnnnnnnncnnnnnnnnnnnnnnnnn

SEQ ID NO: 264776 - DNA, 287 bp, Homo sapiens
  misc_feature: GYAE6OF02F7ORH.24.53.E09.1.454.CMB.1.raw
  modified_base (281)..(287): a, c, t, g, unknown or other
  misc_feature (281)..(287): n is a, c, g, or t
tcagactactatgtcacgaccggtgctcgatttagagagagtgtgttgggtttggggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttccccgccctcctcacatagtagtctggagcgggctggcaaggcgcatagnnnnnnn

SEQ ID NO: 264777 - DNA, 530 bp, Homo sapiens
  misc_feature: GYAE6OF02IT03D.24.53.E09.1.454.CMB.1.raw
  modified_base (500)..(530): a, c, t, g, unknown or other
  misc_feature (500)..(530): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacagcccccaaaactcctcatttatcgtaacacaatcgccctctgggtccctgaccgattctccgcctccaagtctggcacctcagcctcgctggccatcactggctcagctgacgatggagggtgattactacttgccgtagtcgtacggaagtatcgtttcgggcgggaagggtactaaggcctgacccggtctaagggtcacgcccaaaggtccgtccgtccccctaggtaccaccttcttccggttccccctacccctccctccgtaactacgttacgtacgttctagacgggacgggtccgtacgggaccgaaacgggtccgagaacgttagacnnnnnnnnnnnnnnnnnnnnnnnnnnnnnnn

SEQ ID NO: 264778 - DNA, 540 bp, Homo sapiens
  misc_feature: GYAE6OF02HPUVT.24.53.E09.1.454.CMB.1.raw
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (319)..(320): a, c, t, g, unknown or other
  misc_feature (319)..(320): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
  modified_base (493)..(493): a, c, t, g, unknown or other
  misc_feature (493)..(493): n is a, c, g, or t
  modified_base (536)..(536): a, c, t, g, unknown or other
  misc_feature (536)..(536): n is a, c, g, or t
tcagactactatgtcacgaccggtgctcgatttagagagagtgtgttgggtttggggggtgtggtggtctccactcccgccttgacggggctgctatctgcctcgctggccatcactgggctcaggctgaggatggagggtgattactactgccagtcgtacgaagatgttcggcggagggataagctgaccgtctaggtcagccaaggctcgccccctggtcactctcgttccccacctcctcactatacgtagtcgaggccggtctagggacaacggccgactaagtacgnactncgntncgtncgntacgntcagnngactcagtctgctaatcnggtctnaacgtntacgntaacgngtcnggtactcacgtcnggaacntgctcncgagcgttgaacctgataggacncgttacnctgtcaacgttaccgtcgtactacgtacgtgttaacncgttaagtcgtagacccgtgtacgtactcggttacnctaacggtcattcggtagtaccgtcgtaagtcgtctacggttnacgg

SEQ ID NO: 264779 - DNA, 413 bp, Homo sapiens
  misc_feature: GYAE6OF02G5N51.24.53.E09.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (375)..(375): a, c, t, g, unknown or other
  misc_feature (375)..(375): n is a, c, g, or t
  modified_base (382)..(383): a, c, t, g, unknown or other
  misc_feature (382)..(383): n is a, c, g, or t
  modified_base (385)..(385): a, c, t, g, unknown or other
  misc_feature (385)..(385): n is a, c, g, or t
  modified_base (388)..(413): a, c, t, g, unknown or other
  misc_feature (388)..(413): n is a, c, g, or t
tcagactactatgtcacgaccggtgctcgatttagagagagtgtgttgggtttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgatttatactgttcaacatgggactacngcctcagttctnaggttgtcggcggaggacaggtgaccgtctaagtcagccaaggcctcgcccctgccactctcgtcccaccctcctcacatatacgtctgacggcggctcggacaaggccncgtatgnngncgnnnnnnnnnnnnnnnnnnnnnnnnnn

SEQ ID NO: 264780 - DNA, 689 bp, Homo sapiens
  misc_feature: GYAE6OF02I00Q4.24.53.E09.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagactactatgtcacgaccggtgctcgatttagagagagtgtgttgggtttgggaggcttggtccagcctggggggtccctgagactctcctgtgcagcctctggacttcccctttagtgtacttttggatgacctgggtccgccaggctccgagggacgggctgggagtgggtcggccaatataaggcacgagtggacgtagcatgtactatgtgactcgtgtgagggcattcacatcncaganacaacgccagaactcactgtatcgtagaaatnaaccagcctagacgaggtcgacggacgaggtctatagttaactacgtggtcgaccgtaacattacgtcgaacggtccaaccgttgggaaccgtcggtacctattcgtaacggtaaacttaccgttaccgaagtcgtaacggttcgggggacctaggggaccctaaccgtcggtacccgtaccgttccgtccctcgacgtccctaaccgaaccggaaccggccctacgttcccgtcccgttaccccgtcggccctcccgtcgtccgtaccgacggtaccgcccaacccgtaccgaacgaccgaccaacgaccgccgggtccccgtgggtacccttcggccggttacggtaaccgtaaccggtaccccttcggttaacccaacggttacggtacgttacggttacgaccggg

SEQ ID NO: 264781 - DNA, 620 bp, Homo sapiens
  misc_feature: GYAE6OF02I04A6.24.53.E09.1.454.CMB.1.raw
  modified_base (164)..(164): a, c, t, g, unknown or other
  misc_feature (164)..(164): n is a, c, g, or t
  modified_base (362)..(362): a, c, t, g, unknown or other
  misc_feature (362)..(362): n is a, c, g, or t
  modified_base (505)..(505): a, c, t, g, unknown or other
  misc_feature (505)..(505): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(599): a, c, t, g, unknown or other
  misc_feature (597)..(599): n is a, c, g, or t
  modified_base (601)..(601): a, c, t, g, unknown or other
  misc_feature (601)..(601): n is a, c, g, or t
  modified_base (605)..(605): a, c, t, g, unknown or other
  misc_feature (605)..(605): n is a, c, g, or t
  modified_base (608)..(620): a, c, t, g, unknown or other
  misc_feature (608)..(620): n is a, c, g, or t
tcagactactatgtcacgaccggtgctcgatttagagagagtgtgttgggtttgggggctgtttttggaagctgcttgtactagagggtcaccatctcctgcactgggagcaacatcggcgcaggttttgatgtccactggtacaagcagccttaccaaaaacncgcccccaaactcctcattttatcgtaacaacaatccggccctcgttcggggtccctgaccgtattcctcccgccctaccgtaagttccgtcggcctacccttccgacggtcccctccggccgttacgggccctaatccgtaaccggttcggggtcctacccgagggtccttggaaggtacgttagggaacggggttntaacgtttacctaacgtcgacccgtaggttccggtaacgaagtacgtttcggtaccggacgggtacgggaactaacgcgttcgaccgtcgttagggtcaacgccgaaggtcctccgcccgtcgcttacctcgtccgtcccccncctcaccacgtacttaggtacctcgtaggaccggcgggtacgtcggacgtaacggcacttaaggcgtncngncgntcganctnctgncgncnnncncgcngcnnnnnnnnnnnnn

SEQ ID NO: 264782 - DNA, 630 bp, Homo sapiens
  misc_feature: GYAE6OF02HT3TO.24.53.E09.1.454.CMB.1.raw
  modified_base (352)..(352): a, c, t, g, unknown or other
  misc_feature (352)..(352): n is a, c, g, or t
tcagactactatgtcacgaccggtgctcgatttagagagagtgtgttgggtttgggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccattcaccatctccagagacaacgccagaactcactgtatctaggaaatggaccagcctgagagtacgagacacgctatgtattactgtgacgacatactcagacacctggacgtcgactatcngaactacttcagactagttcggggccagggtcctacccgtggtcctaccgtcctcctcacgcctaccaccgaacgggtcccagttcccggttacccttccccgtcgggtcccgtccctcgtcccgttcccgaaggtccgaccctacccgtaccgacgaccggaccaaccggtacgcccgggtaccccgtggggtccctcgggtcccgttacgggtccgtaaaccggttacccttaacccgttacccgaacgtaacgtttacggtacgttacgtacggg

SEQ ID NO: 264783 - DNA, 393 bp, Homo sapiens
  misc_feature: GYAE6OF02HK9S7.24.53.E09.1.454.CMB.1.raw
  modified_base (384)..(393): a, c, t, g, unknown or other
  misc_feature (384)..(393): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtgattactactgccagtcgtcgaagatggttcggcggagggactaagctgaccgtcctaggtcagccaaggctcgccccctggtcactctcgttccccgccctcctcacatagtagtctggacgcgggctggacgaacggcgcatagnnnnnnnnnn

SEQ ID NO: 264784 - DNA, 387 bp, Homo sapiens
  misc_feature: GYAE6OF02G8IHY.24.53.E09.1.454.CMB.1.raw
  modified_base (373)..(387): a, c, t, g, unknown or other
  misc_feature (373)..(387): n is a, c, g, or t
tcagactactatgtcacgaccggtgctcgatttagagagagtgtgttgggtttgggagcaacatcggcgcaggttttgatgtccactggtacaagcagcttccaaaaaacagccccccaaactcctcatttatcgtaacaacaatcggccctctggggtccctgaccgattctccgcctccaagtctggcacctcagcctcgctggccatcactggctccaggctgaggatgaggtgattactactgccagtcgtcgaagatgtcggcggaggactaagctgaccgtctagtcagcccaaggctcgccccctcggtcactctcgttcccactccctcacatagtatctgagcgggctggcaaggcgcaatagnnnnnnnnnnnnnnn

SEQ ID NO: 264785 - DNA, 296 bp, Homo sapiens
  misc_feature: GYAE6OF02JEJZL.24.53.E09.1.454.CMB.1.raw
  modified_base (284)..(296): a, c, t, g, unknown or other
  misc_feature (284)..(296): n is a, c, g, or t
tcagactactatgtcacgaccggtgctcgatttagagagagtgtgttgggtttgggggtggtggtggtctccactcccgccttgacgggctgctatctgcctcgctggccatcactgggctccaggctgaggatggaggtgattactactgccagccgtacgaagatgttcggcggagggactaagctgaccgtcctaggtcagcccaaggctcgcccccgtggtcactctcgtccccaccctcctcacatagtagtctgagtcgggctggcaaggcgcatagnnnnnnnnnnnnn

SEQ ID NO: 264786 - DNA, 754 bp, Homo sapiens
  misc_feature: GYAE6OF02GFCP9.24.53.E09.1.454.CMB.1.raw
  modified_base (253)..(253): a, c, t, g, unknown or other
  misc_feature (253)..(253): n is a, c, g, or t
  modified_base (656)..(656): a, c, t, g, unknown or other
  misc_feature (656)..(656): n is a, c, g, or t
  modified_base (740)..(740): a, c, t, g, unknown or other
  misc_feature (740)..(740): n is a, c, g, or t
tcagactactatgtcacgaccggtgctcgatttagagagagtgtgttggggttggggactgttttggaagctgcttgtaccagacgggtcaccatctcctgcactggagcaacatcggcgcgacggtttagatggtccacgtcggtacaagccacgtccttaccaaaaactcgacccccaaacgtccctacgaatttagtacgtaaccaaacaattccggccctcgtcggggtccctaggaacccgtattacncccgtccctaccaaggttccgtaggacctaccgtctacggtccctacgctaggaccatccaacggtcgggcctaccgaggtcctaggacgtattacggagggtacgtaacttacctaacgtgaccctaggttacgtacgaagtactcggttaccggacggtacggacttacggaccttacggaacccggttccgtacgggtaccctaaccggaccccgtaaagggtccccgtacccggtcccccccgtttagggtaccctaccttaccccggttccgggttacccccccgtccccgtttaccgttcccggaaacctaacggttaaccggttaacgttaccgttaggtaaccgggccggggtaccgttagggaccggaacgggtcccgacgtacggttaacggngtacgcgagtacggagtcggacgacgtcgagcgcgacgtcgacgtacgcgaccgtacgacgtacgtcgtctcgtcgtctctccncgtctctctctctc

SEQ ID NO: 264787 - DNA, 697 bp, Homo sapiens
  misc_feature: GYAE6OF02GP1GY.24.53.E09.1.454.CMB.1.raw
tcagactactatgtcacgaccggtgctcgatttagagagagtgtgttgggtttggaggtctcagagaggagccttagccctggagtccaaggcctttccacttggtgatcagcactgagcacagaggactcaccatggaaattggggctgagcttgggtttccttgttgctattttagaaggtgtccagtgtgaggtgcaactggtggagtcgtgggggaggcgttggtccacggtccgtcggggggtccctggacgtaccttctccgtgtgccagcctcgtggacttcccctttagtcgtacgttttggatgaccgtgggtcccgctacggcctccgaggggccgggtcgtgggtaggtcgggtcgaccgtaaattaacgaacggcctaaccggagtagggtacgtacgctaacgtgtaactagttggcggtaccttcgtacggttggaaaccgggtcccgtattacccaaccgtactccttacccgagaaccgaacccaaaccggacccccaaagaaccctctaaccgttaggttaactaccgtaggtaaacctagaccctacggccctaggaacgaggtaccggaaggtacaacgggtcttaagttcggttattaccgttaggtccggaacccgtaccgtaaacgttactacccgtaagtccccgacgtacgggtaacggtccgaccgtaaccg

SEQ ID NO: 264788 - DNA, 668 bp, Homo sapiens
  misc_feature: GYAE6OF02I9DL2.24.53.E09.1.454.CMB.1.raw
  modified_base (163)..(163): a, c, t, g, unknown or other
  misc_feature (163)..(163): n is a, c, g, or t
  modified_base (315)..(315): a, c, t, g, unknown or other
  misc_feature (315)..(315): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
  modified_base (640)..(641): a, c, t, g, unknown or other
  misc_feature (640)..(641): n is a, c, g, or t
  modified_base (643)..(644): a, c, t, g, unknown or other
  misc_feature (643)..(644): n is a, c, g, or t
  modified_base (647)..(647): a, c, t, g, unknown or other
  misc_feature (647)..(647): n is a, c, g, or t
  modified_base (651)..(651): a, c, t, g, unknown or other
  misc_feature (651)..(651): n is a, c, g, or t
  modified_base (653)..(656): a, c, t, g, unknown or other
  misc_feature (653)..(656): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
  modified_base (664)..(665): a, c, t, g, unknown or other
  misc_feature (664)..(665): n is a, c, g, or t
  modified_base (667)..(668): a, c, t, g, unknown or other
  misc_feature (667)..(668): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngcccccaaaactcctcattttactcgtaacaacaatccggccctcgtcggggtccctggaccgattccgccgcctaccaagtcctggccacctcacgccttcgctcggccatccacgtgggcctccgaggcctaggacgtagtggacgggtntaattaccgacgtcgaccgtaggtccggttacgaagtacgttcgggttccgggacgggaacggtaacgttaacgcgttacggaaccccgttacgtacgggtaccaacggacccgtaacggtcccgttccggaccccccgtttaggtaccctaaccgtttccgttaccccgtttccccccgaacccctttaccctccgaaacgttaacgtttaacggttacgttaccggtacgggaaccgggttcccgggtaccggtacgggtaaccgtaaccgggaccgtaccgtaacgttacgnacgtncgcncgcncngcgcnctcgngcgcnnanncgngtcncnnnncancnncnncnn

SEQ ID NO: 264789 - DNA, 517 bp, Homo sapiens
  misc_feature: GYAE6OF02GBKE9.24.53.E09.1.454.CMB.1.raw
  modified_base (485)..(485): a, c, t, g, unknown or other
  misc_feature (485)..(485): n is a, c, g, or t
  modified_base (487)..(517): a, c, t, g, unknown or other
  misc_feature (487)..(517): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacagccccccaaaactccctcatttatcgtaaacaacaatccggccctcgtggggtccctgaccgattctccgcctccaagtctggcacctcgacgcctccgcttcgggcctatccacgttcggggcctccaggcctgagggattggagggtgatttactactgccagtcgtacgaagtatggtcgggcgggagggactaagctgaccgtctaggtcacgcccaaggctcgccccgtggtaccactcgtcgttccccacccttccgtaccactatagtacgtcgtagagggccgggctgggaccgaacgggccgcgtaagtagcngnnnnnnnnnnnnnnnnnnnnnnnnnnnnnnn

SEQ ID NO: 264790 - DNA, 697 bp, Homo sapiens
  misc_feature: GYAE6OF02H068A.24.53.E09.1.454.CMB.1.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
tcagactactatgtcacgaccggtgctcgatttagagagagtgtgttgggtttgggaggcttggtccagccgtggggggtccctgagactctcctgtgcagcctctggactttcccctttagtgtacttttggatgacctgggtccgccaggctccgagggacggggctggaggtgggtcgggccaaatagtaaggcaacggatgggacgtagcagtgtactagtgtaggactcgtgtaggaacgggccattccaacctatcctaccaagaacgacaaaccgccaaacgaactacacgtgtactcgtggaaaatgaaccncggcctgaagagtacggaaggacacggcttaagtcggtaattacgngtggacccacaatgtccgaagcaccgtaggacgttccgctagttactagtaaactccttacgaacgtcgtaagttccgggggaaccaggggaccctacccgttcggaccgtcccgtacctctacccgacgtaccctcccgaaacccgaaccgggcccgtaacttccccgggtttacccctacccccgttcgggcccgtcccgtacgttcccgaccgtaacggaccgcgttacccgacgacgacggacaacgcgtaccggccggtacggtccacggtccgagtaccgtaaacggaccttaccgttacccaagtacgtaagtcgtcggtacgg

SEQ ID NO: 264791 - DNA, 701 bp, Homo sapiens
  misc_feature: GYAE6OF02JUUTJ.24.53.E09.1.454.CMB.1.raw
  modified_base (148)..(148): a, c, t, g, unknown or other
  misc_feature (148)..(148): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (400)..(400): a, c, t, g, unknown or other
  misc_feature (400)..(400): n is a, c, g, or t
  modified_base (438)..(438): a, c, t, g, unknown or other
  misc_feature (438)..(438): n is a, c, g, or t
tcagactactatgtcacgaccggtgctcgatttagagagagtgtgttgggtttggggaggcgttggtccagccgtggggggtccctggagactatcctgtgcagcctctggattcccctttagtgactttttggatgacctgggtccncaggctccgagggacgggctggagtggggtggccaagtataaggcacgatggacgtagcatgtacatgngactngngaggcctattcacntcacaganacacnccanaactcactnatctagaatgacagctganaggtcaggactacggactagtagtattacgacgttgacggaccagtactcgaanccgtaacgtggacttcggactagtactacgaattccttacgctacgtaggttaccgggaccgngggaccctccgtacggtacctaccgtccgtaccgtacncccggtaccgttcccaaccggaccggtacctaccgtttccggtaccccttaccccggccggtcccgtacccgtccgacccgttaccgacggtacccgacccggaaccccggttacccggtaacgaaccggtacccgaacgggtaacccgggcccgggacccggttacgggcccgttccggtaccggtacgggtaacccggtacgtaaccccgtttaccggttaccccaacttaccgggttaacgttcccggtagtaccggggg

SEQ ID NO: 264792 - DNA, 374 bp, Homo sapiens
  misc_feature: GYAE6OF02I2N2E.24.53.E09.1.454.CMB.1.raw
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (300)..(302): a, c, t, g, unknown or other
  misc_feature (300)..(302): n is a, c, g, or t
  modified_base (304)..(374): a, c, t, g, unknown or other
  misc_feature (304)..(374): n is a, c, g, or t
tcagactactatgtcacgaccggtgctcgattttagagagagtgtgttggggtttgggggggtgtggtggtctccactcccgccttgacggggctgctatctgcctcgctggccatcactgggctccaggctgaggatgagggtgattacgactgccaagtcgtcgaagatggttcggcggagggactaagctgacgtcctaggtcagccaaggcncgccccctggtcactctcgttcccccaccctcctcactatagtacgtctgagcggactgggcaaggccgacaagtagangatcnnnannnnnnnnnnnnnnnnnnnnnnnnnnnnnnnnnnnnnnnnnnnnnnnnnnnnnnnnnnnnnnnnnnnnnnn

SEQ ID NO: 264793 - DNA, 448 bp, Homo sapiens
  misc_feature: GYAE6OF02F5APJ.24.53.E09.1.454.CMB.1.raw
  modified_base (161)..(161): a, c, t, g, unknown or other
  misc_feature (161)..(161): n is a, c, g, or t
  modified_base (286)..(286): a, c, t, g, unknown or other
  misc_feature (286)..(286): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (435)..(448): a, c, t, g, unknown or other
  misc_feature (435)..(448): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccagctgagatgagggtnattacactgccaggtcgtacgaagtatcggttcgggcgggtagggactaagctgaccgttctaggtcagacccgaaggcctcgccccctggtcactctcgtccccaccctcncacatgtatctgagcgggctggcaaggccncatacgnnnnnnnnnnnnnn

SEQ ID NO: 264794 - DNA, 440 bp, Homo sapiens
  misc_feature: GYAE6OF02HMX1U.24.53.E09.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (429)..(440): a, c, t, g, unknown or other
  misc_feature (429)..(440): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttccaaaaacagccccccaaactcctcatttatcgtaacaacaatcggccctctggggtccctgaccgattctccgcctccaagtctggcacctcagcctcgctggccatcactgggctccaggctgaggatgagggtgattactactgccagtcgtacgaagatgttcggaggaggactaagctgaccgtctaggtcagcccaaggcctcgccccctcggtcactctcttcccaccctcctcacatacgtntctgngcgggctggacaggcnatagnnnnnnnnnnnn

SEQ ID NO: 264795 - DNA, 530 bp, Homo sapiens
  misc_feature: GYAE6OF02HTNMJ.24.53.E09.1.454.CMB.1.raw
  modified_base (163)..(163): a, c, t, g, unknown or other
  misc_feature (163)..(163): n is a, c, g, or t
  modified_base (505)..(530): a, c, t, g, unknown or other
  misc_feature (505)..(530): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgccccccaaactcctcatttatcgtaacaacaatccggaccctctcggggtccctgaccgattctccgcctccaagtctggcacctcagcctcgctggccagtcacgtcgggcctccacggctggaggattgggaagggtgaactttactaacgtcgacccagtccggtacgaagtattggttcggccgggaagggacttaagcgttgaacccgttccgagggtccacgcccgaaggcctcgcccccgtcggtcaccttctccgtttccccacccgttcctcgacctatacggtacgttcacggtagcccgggtctacggggcaagggccactagacggannnnnnnnnnnnnnnnnnnnnnnnnn

SEQ ID NO: 264796 - DNA, 290 bp, Homo sapiens
  misc_feature: GYAE6OF02JGODE.24.53.E09.1.454.CMB.1.raw
  modified_base (282)..(290): a, c, t, g, unknown or other
  misc_feature (282)..(290): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggaggactaagctgaccgtctaggtcagcccaaggctcgccccctggtcactcttcgttccccaccctcctcacatagtagtctgaggcgggctggcaaggcgacatgnnnnnnnnn

SEQ ID NO: 264797 - DNA, 504 bp, Homo sapiens
  misc_feature: GYAE6OF02FJLLO.24.53.E09.1.454.CMB.1.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (472)..(477): a, c, t, g, unknown or other
  misc_feature (472)..(477): n is a, c, g, or t
  modified_base (479)..(504): a, c, t, g, unknown or other
  misc_feature (479)..(504): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacagccccccaaaactccctcatttatcgtaacaacaatcggccctctggggtccctgaccgattcnccgcctccaagtctggccacctcagcctcgctggccatcactgggctccaggctgaggangaggtgattactactgcccagtcgtcgaagatggttcgggcggaggggactaagctagacccgttcctaggtcacgtccccgaaggtctcggccccctcggtacactctcgtcccctaccctcctcacacgtagtacgtctggacggccgggctcgggaccgtaaaggccgactagttaggactgnnnnnngnnnnnnnnnnnnnnnnnnnnnnnnnn

SEQ ID NO: 264798 - DNA, 304 bp, Homo sapiens
  misc_feature: GYAE6OF02F4UMN.24.53.E09.1.454.CMB.1.raw
  modified_base (294)..(297): a, c, t, g, unknown or other
  misc_feature (294)..(297): n is a, c, g, or t
  modified_base (299)..(304): a, c, t, g, unknown or other
  misc_feature (299)..(304): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtgattactactgccagtcgtcgaagatgttcggcggagggactaagctgaccgtcctaggtcagcccaaggctcgccccctggtcactctcgttccccaccctcctcacatagtagtctaggacgcggggtctacgggccaaagggcacgtaatagnnnncnnnnnn

SEQ ID NO: 264799 - DNA, 288 bp, Homo sapiens
  misc_feature: GYAE6OF02GSQUB.24.53.E09.1.454.CMB.1.raw
  modified_base (285)..(288): a, c, t, g, unknown or other
  misc_feature (285)..(288): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatggagggtgattactactgccagtcgtcgaagatgttcggcggagggactaagctgaccgtcctaggtcacgcccaaggctcgccccctcggtcactctcgttccccgccctcctacacatagtagtctgagcgggctggcaaggtcgcatagnnnn

SEQ ID NO: 264800 - DNA, 629 bp, Homo sapiens
  misc_feature: GYAE6OF02IBKFO.24.53.E09.1.454.CMB.1.raw
  modified_base (161)..(161): a, c, t, g, unknown or other
  misc_feature (161)..(161): n is a, c, g, or t
  modified_base (226)..(226): a, c, t, g, unknown or other
  misc_feature (226)..(226): n is a, c, g, or t
  modified_base (599)..(599): a, c, t, g, unknown or other
  misc_feature (599)..(599): n is a, c, g, or t
  modified_base (623)..(623): a, c, t, g, unknown or other
  misc_feature (623)..(623): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttaccaaaaacncgacccccaaactcctacatttatcgtaacaacaagtccgcctcgtgggtccctgaccgacttcnccgcctaccaagtctcggcacctcacgcctcgctcggaccatccacgtgggcctcgacggtctaggaggactgggacgggtgtaacttacgtaacgcgacctaggtccggtacggaaagcgttggttacgggcggaacgggtactaaacggctacgtacccgttcggtaacggtcaccgtcccgaaggtcccttaccggcccccgtggtaccacctttccgtacgtttccccacccgtttccactaacgtaacgtagttaccgtcgtacgggacgtccgggtagtacgggacggtaacggacgcgtaacgttaagcctgacgagtgcgcgtcgtcgacgacgctcgctgtcgcgcgtcgactcgtcgtcgacngtcgtcgcgtcgcgtcgtagtacnctatcg

SEQ ID NO: 264801 - DNA, 496 bp, Homo sapiens
  misc_feature: GYAE6OF02GX18V.24.53.E09.1.454.CMB.1.raw
  modified_base (162)..(162): a, c, t, g, unknown or other
  misc_feature (162)..(162): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
  modified_base (466)..(496): a, c, t, g, unknown or other
  misc_feature (466)..(496): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattccnccgcctccaagtctggcacctcagcctcgctggccatcactggcctcaggctgagntgaggtnattacactcgccagtccgtcgaagngtcggttcggacggagggtactaaggcctagaccgtctaggtcacgaccgaagctcgccccctggtccactccgttctccccaccctccncactatacgtactntacggacgccgggtntcggacgtaacggccgtacaagtcgntagcagcnnnnnnnnnnnnnnnnnnnnnnnnnnnnnnn

SEQ ID NO: 264802 - DNA, 302 bp, Homo sapiens
  misc_feature: GYAE6OF02IJOD0.24.53.E09.1.454.CMB.1.raw
  modified_base (287)..(302): a, c, t, g, unknown or other
  misc_feature (287)..(302): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctcgccccctggtcactctcgttccccaccctcctcactattacgtagtctgaggcgggctggcaagggccgcatagnnnnnnnnnnnnnnnn

SEQ ID NO: 264803 - DNA, 750 bp, Homo sapiens
  misc_feature: GYAE6OF02G0TNR.24.53.E09.1.454.CMB.1.raw
  modified_base (296)..(296): a, c, t, g, unknown or other
  misc_feature (296)..(296): n is a, c, g, or t
tcagactactatgtcacgaccggtgctcgatttagagagagtgtgttgggtttgggaggcttggtccagcctggggggtccctgagactctcctgtgcagcctctggatttcccctttagtgactttttggatgacctgggtccgccaggctccgaggggacgggctggagtgggtggaccaatataaggcacgatggacgtagcatgtactatgtggactctgtgaagggccattccaccatctccagagacaacgccagaactcactgtatctaggaaatcgaccagcctgagngtcgaaggacacggctagtgttatactgtcgcacctagtatcacgaccaccgtggacgtcacgtattcgtaagtaacttaccttccgaagccgttaaggtttccgggggacccgaacggggcccttaaaccccggtccgggttacccctaacccgggttcccttccccgtaccgtaccggtaccccgtaccccgaaacccgggaaacccgggccccctaacggttccccgggtttacccccgtttccccccggttgggcccccgttccccgtaccgggtccctacccggtacggaccgtacccgtacccgtacccggaacgaccggaccgtaaccgacgggcccggtcccgggtaccgggtaccgttccggacccggtttacgggaaccgtaacggttaccctttaacccgttacccggaacttaaccggtttaagttaccgtacgtaccgggg

SEQ ID NO: 264804 - DNA, 563 bp, Homo sapiens
  misc_feature: GYAE6OF02HNYB9.24.53.E09.1.454.CMB.1.raw
  modified_base (163)..(163): a, c, t, g, unknown or other
  misc_feature (163)..(163): n is a, c, g, or t
  modified_base (303)..(303): a, c, t, g, unknown or other
  misc_feature (303)..(303): n is a, c, g, or t
  modified_base (532)..(563): a, c, t, g, unknown or other
  misc_feature (532)..(563): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaatcagcttaccaaaaacngcccccaaatcctcatttatcgtaaacaacaatccggccctcgtggggtccctgaccgattcctccgcctcaagtctggcacctcagccctcgctcggcctatcacgtcgggcctccgaggctaggaggactggagggtnacttactactcgcctagtcggtacgaaagtacttcggttacggacgggaagggtactaaacggctcggaacccgttcgttacggccgaacggtaccccgaaagggtcctaccggtccccccgttagggtcctaccgttcctaccggtttcccccaccccttccactaactagtacgttacgtacgtcggacggtccgggtcgtacgggacgaacggcgagtacgagctnnnnnnnnnnnnnnnnnnnnnnnnnnnnnnnn

SEQ ID NO: 264805 - DNA, 516 bp, Homo sapiens
  misc_feature: GYAE6OF02FZ1GR.24.53.E09.1.454.CMB.1.raw
  modified_base (331)..(331): a, c, t, g, unknown or other
  misc_feature (331)..(331): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (485)..(490): a, c, t, g, unknown or other
  misc_feature (485)..(490): n is a, c, g, or t
  modified_base (492)..(516): a, c, t, g, unknown or other
  misc_feature (492)..(516): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgaccccccaaactcctcatttatcgtaacaacaatcggccctctcggggtccctgaccgattcctccgcctccaagtctggcacctcagcctcgctggccatccactcgggctccaggctgaggatggaggtgattactactgccagtcgtacgaagtatggtcggnggaggactaagcgtcgaccgtctaggtccacggacccaaggcctccgccccgtcggtacctactcgtcgttccccaccgtccctccctacacgtagttaacgtcgtcgtacggcggccggtcggtcggacggacgcgtacgtactagncngtcnnnnnngnnnnnnnnnnnnnnnnnnnnnnnnn

SEQ ID NO: 264806 - DNA, 290 bp, Homo sapiens
  misc_feature: GYAE6OF02FSA5V.24.53.E09.1.454.CMB.1.raw
  modified_base (279)..(290): a, c, t, g, unknown or other
  misc_feature (279)..(290): n is a, c, g, or t
tcagactactatgtcacgaccggtgctcgatttagagagagtgtgttgggtttgggggtgtggtggtctccactcccgccttgacggggctgctatctgcctcgctggccatcactggctccaggctgaggatgagggtgattactactgccagtcgtcgaagatgttcggcggagggactaagctgaccgtcctaggtcagcccaaggctgccccctggtcactctgttccccaccctcctcacatagtatctgacgcgggctggcaaggcgcatagnnnnnnnnnnnn

SEQ ID NO: 264807 - DNA, 477 bp, Homo sapiens
  misc_feature: GYAE6OF02IC2BX.24.53.E09.1.454.CMB.1.raw
  modified_base (160)..(160): a, c, t, g, unknown or other
  misc_feature (160)..(160): n is a, c, g, or t
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
  modified_base (451)..(477): a, c, t, g, unknown or other
  misc_feature (451)..(477): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttccaaaaacngcccccaaatcctcatttancgtaaacaacaatccggccctcgtcgggtccctgaccgattccnccgcctccaagtcnggccacctnagcctcgactcggccatcacgtggcctcaggctgacgntggaggtnattacactgccagtcgtcgaagntgtcggcggaggacagctgccgttgaggtcacgccgagctcgcccctggcactcctctaccccncctctacactactgttactcgtgtacgcgggntcgggacgaaacgggtccgactaaggtagcatcgntcannnnnnnnnnnnnnnnnnnnnnnnnnn

SEQ ID NO: 264808 - DNA, 295 bp, Homo sapiens
  misc_feature: GYAE6OF02G31TV.24.53.E09.1.454.CMB.1.raw
  modified_base (283)..(295): a, c, t, g, unknown or other
  misc_feature (283)..(295): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacatagtagtctgagccgggctggcaaggcgcatgnnnnnnnnnnnnn

SEQ ID NO: 264809 - DNA, 597 bp, Homo sapiens
  misc_feature: GYAE6OF02JEJNB.24.53.E09.1.454.CMB.1.raw
  modified_base (163)..(163): a, c, t, g, unknown or other
  misc_feature (163)..(163): n is a, c, g, or t
  modified_base (564)..(569): a, c, t, g, unknown or other
  misc_feature (564)..(569): n is a, c, g, or t
  modified_base (571)..(572): a, c, t, g, unknown or other
  misc_feature (571)..(572): n is a, c, g, or t
  modified_base (574)..(597): a, c, t, g, unknown or other
  misc_feature (574)..(597): n is a, c, g, or t
tcagactactatgtcacgaccggtgctcgatttagagagagtgtgttgggtttgggggctgttttggaagctgcttgtaccagagggtcaccatctcctgcactgggagcaacatcgggcgcaggttttgatgtccactggtacaagcagcttaccaaaaacncgaccccccaaactcctcaattttactacgtaaacaacaactccggccctcgtcggggtccctagaccgtattcgtcccgccttaccgaagtctggccaaccgtcacggcctcgcgtcggccatcacgtgggctccgaggcctaggaggaagtggaggggtatacttaactcgttacgcccgtagttccggtaacgtaaggtacgttacggttcgggacgggacgggtaactaaacggctacggacccggttcgtaacggaccgacgacccgtaaggtcccgccgtcccccgtggtaccaccttcgttcccgttcccctaccgtacctactacgtaacgttacgtaccggtctaacggcgggccggtcggtacgacggacgtacgacgtaattcgatcagnnnnnncnncnnnnnnnnnnnnnnnnnnnnnnnn

SEQ ID NO: 264810 - DNA, 310 bp, Homo sapiens
  misc_feature: GYAE6OF02H0AZE.24.53.E09.1.454.CMB.1.raw
  modified_base (279)..(279): a, c, t, g, unknown or other
  misc_feature (279)..(279): n is a, c, g, or t
  modified_base (284)..(310): a, c, t, g, unknown or other
  misc_feature (284)..(310): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgagatggagggtgattactactgccagtcgtacgaagatgttcggcggagggactaagctgaccgtcctaggtcagcccaaggctcgccccctcggtcactcctcgttccccgccctcctcacatagtagtctgagcggctggcaaggcanatagnnnnnnnnnnnnnnnnnnnnnnnnnnn

SEQ ID NO: 264811 - DNA, 398 bp, Homo sapiens
  misc_feature: GYAE6OF02GUIVN.24.53.E09.1.454.CMB.1.raw
  modified_base (110)..(110): a, c, t, g, unknown or other
  misc_feature (110)..(110): n is a, c, g, or t
  modified_base (387)..(389): a, c, t, g, unknown or other
  misc_feature (387)..(389): n is a, c, g, or t
  modified_base (391)..(398): a, c, t, g, unknown or other
  misc_feature (391)..(398): n is a, c, g, or t
tcagactactatgtcacgaccggtgctcgatttagagagagtgtgttgggtttgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagccctgctggccatcactgggctccaggctggagatggaggtgattactctgcctagtcgtacgaagattgtcggcggaggactaagctgaccgtcctgtccagcccgaaggctcgccccctacggtccgacctctcgttccccaccctcctcactatagtgtcctgacggcggatggctaaggcgcatagnnntnnnnnnnn

SEQ ID NO: 264812 - DNA, 564 bp, Homo sapiens
  misc_feature: GYAE6OF02HKXRL.24.53.E09.1.454.CMB.1.raw
  modified_base (164)..(164): a, c, t, g, unknown or other
  misc_feature (164)..(164): n is a, c, g, or t
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (487)..(487): a, c, t, g, unknown or other
  misc_feature (487)..(487): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
  modified_base (536)..(564): a, c, t, g, unknown or other
  misc_feature (536)..(564): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcagggttttgatgtccactggtacaagcagcttaccaaaaacncgacccccaaactcctcattttatccgtaaacaacaatccggcccctgtcggggtccctgaccgattcctcccgcctaccaagtctcggaaccctnacgcctcgctggccattccgacgtggcctccgaggctaggaggtatggagggtntattacgtactcggctaggttccggtacggaagtatcgggttaccgggaccgggaaggggtaactaacgccgttacggtacccgttccggttaggaccgacgaccccgaaggcctccgcccccgttgactaccgtctaccgtccccaccctcctacacgtattacgtcgtcgngacggccgggctcggacgaacgggctacgagtagnagtncatcganctnnnnnnnnnnnnnnnnnnnnnnnnnnnnn

SEQ ID NO: 264813 - DNA, 457 bp, Homo sapiens
  misc_feature: GYAE6OF02G0JNL.24.53.E09.1.454.CMB.1.raw
  modified_base (162)..(162): a, c, t, g, unknown or other
  misc_feature (162)..(162): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(457): a, c, t, g, unknown or other
  misc_feature (436)..(457): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggccacctcagcctcgctggccatcactgggctccaggctgaggntgagggtnattactacngccagtcgtcgaagngtggtcggcggaggactaagctgacccgtctaggcacgcccaaggcctcgcccctgcactcgtcgttcccnccctctcacatagtcgtctgacggcgcgtgactaaggcgacatagnancnnnnnnnnnnnnnnnnnnnnnn

SEQ ID NO: 264814 - DNA, 712 bp, Homo sapiens
  misc_feature: GYAE6OF02H928A.24.53.E09.1.454.CMB.1.raw
  modified_base (330)..(330): a, c, t, g, unknown or other
  misc_feature (330)..(330): n is a, c, g, or t
tcagactactatgtcacgaccggtgctcgatttagagagagtgtgttgggtttgggagcttggtccagcctggggggtccctgagactctcctgtgcagcctctggacttcccctttagtgactttttggatgacctgggtccgccaggctccgagggacgggctggagtgggtggccaatataaggcacgatggacgtagcatgtactatcgtggactctgtgaagggccgattcacatctcagagacaacgccagaactcacttagtatactaggaaatgaccagcctgagagtacgagacaacggcttaatgtaatttacctgtacncgtaacatacgtcaagcaacctgggaacgttccgctactagtataaacctttacgtaccaggtacaggtttcgggggacccaacggggcccttaaccccgttagggttccctaaccccggttccttaccccgtacgacgtacccgttacccgaaacccgaaacgggacccgtaaccgttcccgggttaccgtttaccccccgtacgggtacccgccccgttcgcccgttacccgaagggtaccgtacccgacccgtacccgacgacgaccgtaaccgaccggtacccggtaccccggtcggaccgtcgtacccgtcgggttaaccaaccgggtaccttaccgttacccgtaaccttacgtaacggttacggttacctacggg

SEQ ID NO: 264815 - DNA, 386 bp, Homo sapiens
  misc_feature: GYAE6OF02FSCQC.24.53.E09.1.454.CMB.1.raw
  modified_base (110)..(110): a, c, t, g, unknown or other
  misc_feature (110)..(110): n is a, c, g, or t
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (375)..(386): a, c, t, g, unknown or other
  misc_feature (375)..(386): n is a, c, g, or t
tcagactactatgtcacgaccggtgctcgatttagagagagtgtgttgggtttgggagcaacatcggcgcaggttttgatgtccactggtacaagcagcttccaaaaacngcccccaaactcctcatttatcgtaacaacaatcggccctctggggtccctgaccgattctccgcctccaagtctggcacctcagcctcgctggccatcactgggctccaggctgaggatggagggtnattactactgccagtcgtcgaagatgttcggnggagggactaagctgaccgtctaggtcagcccaaggctcgccccctggtcactctcgtcccacctctcactagtagtctgacgcgggctggacaaggcacatagnnnnnnnnnnnn

SEQ ID NO: 264816 - DNA, 657 bp, Homo sapiens
  misc_feature: GYAE6OF02IK8FB.24.53.E09.1.454.CMB.1.raw
  modified_base (183)..(183): a, c, t, g, unknown or other
  misc_feature (183)..(183): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (636)..(638): a, c, t, g, unknown or other
  misc_feature (636)..(638): n is a, c, g, or t
  modified_base (641)..(642): a, c, t, g, unknown or other
  misc_feature (641)..(642): n is a, c, g, or t
  modified_base (644)..(644): a, c, t, g, unknown or other
  misc_feature (644)..(644): n is a, c, g, or t
  modified_base (646)..(648): a, c, t, g, unknown or other
  misc_feature (646)..(648): n is a, c, g, or t
  modified_base (650)..(652): a, c, t, g, unknown or other
  misc_feature (650)..(652): n is a, c, g, or t
  modified_base (654)..(656): a, c, t, g, unknown or other
  misc_feature (654)..(656): n is a, c, g, or t
tcagactactatgtcacgaccggtgctcgatttagagagagtgtgttgggtttggggactgtttttggaagctgcttgtaccagagggtcaccatctcctgcactgggagcaacatcggcgcaggttttgatgtccactggtacaagcagcttaccaaaaacagccccaaactcctcatttancgtaacaacaatccggccctcgtcggggtccctgaccgtattcctccgccctccaagtctggccacctcacgcctcgctcggccatccacgtgggcctccgaggctggacggtatggagggtgtaatttaccaacgttcggaccgacggtcggtacgaaacgtagttcggttcggggcgggaacggggtactaacggccgttacggtaccccggtctaacgggtccgaccggacccgaaggtccctacccggtcccccggttcggtacctaaccgttcccgtttaccggttcccccctaaccccgtttccctaacctaaccgtaacgttttaaacgggttcgttaccggttacgggtaaccggggcccggggttacgtaccggggtaacctaaaaccggggccgtaaccgttaggttaaagctacgnagancngncgcgcnacgncnntcacnnncgnncnannncnnncnnnc

SEQ ID NO: 264817 - DNA, 382 bp, Homo sapiens
  misc_feature: GYAE6OF02FJGL0.24.53.E09.1.454.CMB.1.raw
  modified_base (141)..(141): a, c, t, g, unknown or other
  misc_feature (141)..(141): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (308)..(382): a, c, t, g, unknown or other
  misc_feature (308)..(382): n is a, c, g, or t
tcagactactatgtcacgaccggtgctcgatttagagagagtgtgttgggtttggggggtgtggtggtctccactcccgccttgacggggctgctatctgccctcgctggccatcactggctccaggctgagatgagggtnattactactgccagtcgtcgaagatgttcggcggaggactaagctgaccgtcctaggccagcccaaggcctcgccccccctggtccactcctgttaccccccaccctcctcacatagtactctggacggccgggtctggcaaagggccgaccataaggntgctnacnnnnnnnnnnnnnnnnnnnnnnnnnnnnnnnnnnnnnnnnnnnnnnnnnnnnnnnnnnnnnnnnnnnnnnnnnnn

SEQ ID NO: 264818 - DNA, 300 bp, Homo sapiens
  misc_feature: GYAE6OF02GNZGU.24.53.E09.1.454.CMB.1.raw
  modified_base (279)..(282): a, c, t, g, unknown or other
  misc_feature (279)..(282): n is a, c, g, or t
  modified_base (284)..(300): a, c, t, g, unknown or other
  misc_feature (284)..(300): n is a, c, g, or t
tcagactactatgtcacgaccggtgctcgatttagagagagtgtgttgggtttgggggtgtggtggtctccactcccgccttgacggggcgtgctatctgcctcgctggccatcactgggctccaggctgaggatgagggtgattactactgccagtcgtcgaagatgttcggcggagggactaagctgaccgtcctaggtcagcccaaggctgccccctggtcactctgtccccaccctcctcacatagtagtctgagcgggctggacaggcgcatgnnnntnnnnnnnnnnnnnnnnn

SEQ ID NO: 264819 - DNA, 584 bp, Homo sapiens
  misc_feature: GYAE6OF02GUPAX.24.53.E09.1.454.CMB.1.raw
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (514)..(514): a, c, t, g, unknown or other
  misc_feature (514)..(514): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacggggctggagtgggtggccaatataaggcacgatggacgtagcatgtactatgtgactctgtgaaggccgattcaccatctccagacacaacgcccagaactcactgtatctaggaaatgaccagcctaggagagtcgaggacacggctatgtattactgncgacatancanccacgtggacgtcgacatcgtagtaaacttaccttaccaagctaacggttcgggggacccaaggggccctacccgtggtaccacccgtcctccctacacgtccctacccacccgaacggccctacgtccggtcccttccccgnggcccnccctcgacctccgaggccgtccaccgtccgaganccgacgacggccgaccgtggccgttcgccgttgaccgacgtaccttactcaactactacgtatcgtacgg

SEQ ID NO: 264820 - DNA, 594 bp, Homo sapiens
  misc_feature: GYAE6OF02JFYZE.24.53.E09.1.454.CMB.1.raw
  modified_base (161)..(161): a, c, t, g, unknown or other
  misc_feature (161)..(161): n is a, c, g, or t
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (507)..(507): a, c, t, g, unknown or other
  misc_feature (507)..(507): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttccaaaaacngcccccaaactcctcatttatcgtaacaacaatcggccctcgtggggtccctgaccgattcctccgcctccaagtctggcacctnacgcctcgctggccatcacgtgggcctccaggctgaggatggaggtnattacgactgccagtcgtacgaagntgttcggnggaggactagctcgaccgtctaggtccacgaccgaaggtctcgcccccgtggtccacgttccgtacgttccccacccgttcctaccgtaactacgttacgttacgtcgtacggtaacggccgggtcgtacgggaccgaaacgggccctacgtaacgttaaggccgtgactcgactaccgancgcgacgacgacgtacgcgtcgtacgtacgtacgtcgtagacgtacgtacacgacgacgtacgtacgtcgtacgtacgcgcncntcg

SEQ ID NO: 264821 - DNA, 295 bp, Homo sapiens
  misc_feature: GYAE6OF02FJ6TY.24.53.E09.1.454.CMB.1.raw
  modified_base (284)..(295): a, c, t, g, unknown or other
  misc_feature (284)..(295): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgagcgggctggcaaggcgcatagnnnnnnnnnnnn

SEQ ID NO: 264822 - DNA, 473 bp, Homo sapiens
  misc_feature: GYAE6OF02I0FBP.24.53.E09.1.454.CMB.1.raw
  modified_base (162)..(162): a, c, t, g, unknown or other
  misc_feature (162)..(162): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
  modified_base (442)..(473): a, c, t, g, unknown or other
  misc_feature (442)..(473): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaatcctcatttatcgtaacaacaatcggccctctggggtccctgaccgattctccgcctccaagtctggcacctcagcctcgctggccatcactggctccaggctgagatgagggtnattactactgccagtcgtcgaagatgtcggnggaggactagctgaccgtcaggtcacgcccaaggctcgcccctgtcnctctcgttccccacctccacactactagtacgtcgtggacgcgggtctggacgaacgggccgacagtaggctngcnnnnnnnnnnnnnnnnnnnnnnnnnnnnnnnn

SEQ ID NO: 264823 - DNA, 505 bp, Homo sapiens
  misc_feature: GYAE6OF02JSNY7.24.53.E09.1.454.CMB.1.raw
  modified_base (101)..(101): a, c, t, g, unknown or other
  misc_feature (101)..(101): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (475)..(481): a, c, t, g, unknown or other
  misc_feature (475)..(481): n is a, c, g, or t
  modified_base (483)..(505): a, c, t, g, unknown or other
  misc_feature (483)..(505): n is a, c, g, or t
tcagactactatgtcacgaccggtgctcgatttagagagagtgtgttgggtttgggtagcgaacatcggcgcaggttttgatgtccactggtacaagcagnttaccaaaaacagccccaaactcctcatttatcgtaacaacaatcggccctctgggtccctgaccgattctcccggccctacctagtcgtacgccaccgtccacgtcctccgaacttcggaccctatccacggtccgggtccgtcccgaggaacgttcggaggtaggtcgggtacggtagtacttaaccgtcgtccgacgtcgtacggtaacgagtagtcggtcgggtacggacggacggttagaccgtctacggtcctaggtcccaaggcccnccggacccgnttttccccgaacgttcctaccgtcctccgtaccctacctcctactactaccggttacgtacgtcgacgcgacgtcgcgacgacgcacagnnnnnnncnnnnnnnnnnnnnnnnnnnnnnn

SEQ ID NO: 264824 - DNA, 638 bp, Homo sapiens
  misc_feature: GYAE6OF02HBXER.24.53.E09.1.454.CMB.1.raw
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
  modified_base (604)..(604): a, c, t, g, unknown or other
  misc_feature (604)..(604): n is a, c, g, or t
  modified_base (610)..(638): a, c, t, g, unknown or other
  misc_feature (610)..(638): n is a, c, g, or t
tcagactactatgtcacgaccggtgctcgatttagagagagtgtggttggggtttgggggcttgtttttggaagctgcttgtaccagagggtcaccatctcctgcactggggagcaaacatcggcgctaggttttgatgtccactggtacaagcagccttaccaaaaaacncgacccccaaatcctcattttacncgtaaacaacaatccggccctgtcgggtccctgaccgtattccnccgcctacaagtcgtggccacctcgacgccctcgctcggaccatccacgtcgggcctccgaggtctaggaggagtggaggggtntaactttaccgtacgtgccctaaggtcccgttaggaaagtgttcggttccggggcgggtaaggggtaacttaaggccgtaccggtaccccggttacgtacgggtccaaccgggaccccgtaaagggcccgttccccggccccccggttgggttaccctaacgtttcccgttaaccgttcccccctaacccgttccctactaaccgttaagttaaccggttgttacccgaaggggtccggtaccggggtcttaccggggacgaaaccgggtcggaacttaanggcagnnnnnnnnnnnnnnnnnnnnnnnnnnnnn

SEQ ID NO: 264825 - DNA, 291 bp, Homo sapiens
  misc_feature: GYAE6OF02HQ2TY.24.53.E09.1.454.CMB.1.raw
  modified_base (276)..(276): a, c, t, g, unknown or other
  misc_feature (276)..(276): n is a, c, g, or t
  modified_base (282)..(291): a, c, t, g, unknown or other
  misc_feature (282)..(291): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacatagtagtctgagcgggctggcaaggcncatagnnnnnnnnnn

SEQ ID NO: 264826 - DNA, 544 bp, Homo sapiens
  misc_feature: GYAE6OF02FZKKT.24.53.E09.1.454.CMB.1.raw
  modified_base (162)..(162): a, c, t, g, unknown or other
  misc_feature (162)..(162): n is a, c, g, or t
  modified_base (326)..(326): a, c, t, g, unknown or other
  misc_feature (326)..(326): n is a, c, g, or t
  modified_base (526)..(544): a, c, t, g, unknown or other
  misc_feature (526)..(544): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngaccccccaaactcctctaattttatcgtaaacaacaactccggccctcgtcggggtccctgaccgattcctccgcctccaagtctaggccacctcacgccttcgcctggcccatccacgttgggcctcccgaggcctggaggtatggagggtgtattactacngtaccgaggttcgtcgaagtagtggttcgggcggaagggactaagctacggtacccgtccgtaggtcacgaaccccagggcctacccggccccccgttcggtaccaccttcccgttacgttcccccaccccttacctccaacgtattacgttacgtccttagggcggtccgggtcgtacggacgtacggcgactaagtgnnnnnnnnnnnnnnnnnnn

SEQ ID NO: 264827 - DNA, 743 bp, Homo sapiens
  misc_feature: GYAE6OF02I53E9.24.53.E09.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggctccagggacgggctggagtgggtggccaatataaggcacgatggacgtagcatgtactatgtggactctgtgaggccgtattcaccatccncaganacaacgcccagaactcactgtactgtagaatgaccagcctgagagtcgagacacggtctaatgttacttacgtggtacgccgaacctatactcacgaccaccgtaggacgttcgactactcctagtaacttacttaccagtactagggttccgggacctaggggaccctacccggtcggtccgtaacccggttccttacccgtactaccgtacccctacccaacccggaaccgggtaccccgtaccggttcccggttaccccgtttaccccccggtcgggacccccgtccccgttcggtaccctaccggtaaccgggtacccgtacccgtacccgtaacccggtaacgaccgtacccgaaaccggccggtcccgggacccggtacggggtaccccgtacgggttacccgttaccggggtaacccggtaaccggttacccgtttaaccttaccccgtaaccgttacgtttaaacgggttccgttacggtaaccgggg

SEQ ID NO: 264828 - DNA, 503 bp, Homo sapiens
  misc_feature: GYAE6OF02IS9ES.24.53.E09.1.454.CMB.1.raw
  modified_base (163)..(163): a, c, t, g, unknown or other
  misc_feature (163)..(163): n is a, c, g, or t
  modified_base (462)..(462): a, c, t, g, unknown or other
  misc_feature (462)..(462): n is a, c, g, or t
  modified_base (464)..(465): a, c, t, g, unknown or other
  misc_feature (464)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (474)..(476): a, c, t, g, unknown or other
  misc_feature (474)..(476): n is a, c, g, or t
  modified_base (478)..(490): a, c, t, g, unknown or other
  misc_feature (478)..(490): n is a, c, g, or t
  modified_base (492)..(503): a, c, t, g, unknown or other
  misc_feature (492)..(503): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaaacngccccccaaactcctcattttatcgtaacaacaatcggccctctggggtccctgaccgattctccgcctccaagtcctggcacctcagcctcgctggccatcactgggctccaggctgacggatggagggtgattactactgccaggtcgtcgaagatcggtcggcggagggactaagctgacccgtcctaggtcacgccccaaaggcctcgcccccgttggtccacttctcgtccccaccctcctacactatagtacgtctagacggtcgggctcggacaacggccgacgtattacgngnntnctnacgnnncnnnnnnnnnnnnncnnnnnnnnnnnn

SEQ ID NO: 264829 - DNA, 571 bp, Homo sapiens
  misc_feature: GYAE6OF02JMC3V.24.53.E09.1.454.CMB.1.raw
  modified_base (167)..(167): a, c, t, g, unknown or other
  misc_feature (167)..(167): n is a, c, g, or t
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
  modified_base (538)..(571): a, c, t, g, unknown or other
  misc_feature (538)..(571): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgctaggttttgatggtaccactggtacaaggcagcttaaccaaaacncgacccccaaatcctacatttancgtaaacaacaagtccggccctgtcgggtccctgaccgtattccnccgcctccaagtctggcacctanacgcctcgctcggccatcacgtggcctcgaggctaggaggatcggtagggtctatttactacgtcggtaccgaggtttccgaaggaaacgttgttacgggtttccgggaccgggaaggttaacctaggccgttagaccccgttaggtcgaccgacgacccgtaagggcctcccggaccccttggctaccgttcctaccgttccccctacctccgtaccaagtacgttacgggtactcggtagcgggtaccggtctacgggactccgggntactaggngcnnnnnnnnnnnnnnnnnnnnnnnnnnnnnnnnnn

SEQ ID NO: 264830 - DNA, 549 bp, Homo sapiens
  misc_feature: GYAE6OF02GIF5B.24.53.E09.1.454.CMB.1.raw
  modified_base (162)..(162): a, c, t, g, unknown or other
  misc_feature (162)..(162): n is a, c, g, or t
  modified_base (301)..(301): a, c, t, g, unknown or other
  misc_feature (301)..(301): n is a, c, g, or t
  modified_base (505)..(505): a, c, t, g, unknown or other
  misc_feature (505)..(505): n is a, c, g, or t
  modified_base (509)..(511): a, c, t, g, unknown or other
  misc_feature (509)..(511): n is a, c, g, or t
  modified_base (513)..(515): a, c, t, g, unknown or other
  misc_feature (513)..(515): n is a, c, g, or t
  modified_base (524)..(549): a, c, t, g, unknown or other
  misc_feature (524)..(549): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngccccccaaaactccctcattttatccgtaaacaacaatccggccctgtggggtccctgaccgattctccgcctccaagtctggcacctcacgcctcgctggccatcacgtgggcctccaggctagaggatggagggtnattacctacgtgaccaggtcgtacgaagcgttggtcggcgggaggactaaggctcggtaccgtctaggtcacggcccgaaggcctaccggcccccttcggtctacctcgttccgttccccccgccctccctcaacctacgttaacggtacgttcgtcggacggtccggggtcttacgggccgaaagggtcccgactaagtacgntcgnnncnnnaaaaaaaannnnnnnnnnnnnnnnnnnnnnnnnn

SEQ ID NO: 264831 - DNA, 282 bp, Homo sapiens
  misc_feature: GYAE6OF02IFA0J.24.53.E09.1.454.CMB.1.raw
  modified_base (278)..(282): a, c, t, g, unknown or other
  misc_feature (278)..(282): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggaggactaagctgacgtctagtcagcccaaggctcgcccctcggtcactctcgttcccaccctcctcacatagtagtctgagcggactggcaaggcgcatagnnnnn

SEQ ID NO: 264832 - DNA, 473 bp, Homo sapiens
  misc_feature: GYAE6OF02FLG65.24.53.E09.1.454.CMB.1.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
  modified_base (453)..(473): a, c, t, g, unknown or other
  misc_feature (453)..(473): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacagccccccaaactcctcatttatcgtaacaacaatcggccctctcggggtccctgaccgattcctccgcctcccaagtctggcacctcagcctcgctggccatcacgtgggctcccaggctgaggatgaggtnattactactgccagtcgtcgaagatggtcggngggaggactaagctgaccgtctaggtcacgcccgaaggctcgccccctcggtcactctcgttccccaccctctcacntagtagtcctgacggcgggccgtgggaccaacggtccgacacgtaggcnnnnnnnnnnnnnnnnnnnnn

SEQ ID NO: 264833 - DNA, 583 bp, Homo sapiens
  misc_feature: GYAE6OF02FFT69.24.53.E09.1.454.CMB.1.raw
  modified_base (160)..(160): a, c, t, g, unknown or other
  misc_feature (160)..(160): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttaccaaaacngccccaaatcctcatttatcgtaaacaacaatccggccctcgtcggggtccctgaccgtacttcctccgcctccaacgtctcggccacctcacgcctcgctcggccatcacgtcggctccgaggcctggacggtatggacgggttnaacttacctacncgcctaggtcgtacgaagtnttcggtcgggaggacggactaagcgtacgacccgtcgtaggtccacgcccgaaggtccctaccggtccccgtaggtacctaccgttccgttacccgttaccccaccgttcctaacaactacgttacgtacgtcgtggaacgggtccggtcgtacggaccgaacggctacgagtacgcagcgcncncncncnncncncncncncacncncncncncncgcncncncgtcanacncacacncacanc

SEQ ID NO: 264834 - DNA, 674 bp, Homo sapiens
  misc_feature: GYAE6OF02F35XR.24.53.E09.1.454.CMB.1.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccagggacgggctggagtgggtgccaatataaggcacgatggacgtagcatgtactatgtggactctgtggaagggcctattcaccatctccagagaccaacgccagaactcactgtatcgtaggaaatcgaccagtcctagagngtcgaggacncggtntatcgtattctgtcgaccgactatacncagccacgtggactcgactagtctagaacttcctccaggtacgtagttcggggaccagggccctaaccgtcgtacctaccgtctacccgtcaccgccctacccgaacggaccggcccctacggttcccggttcccctttccccggacggtccccgtccctggcccgtacgacggtaccacccgacccgtacggaacgaccggcctaaaccggcggggaccccgttccgggtcgggccgttacccgggacccgtttacggggtaaaccgtaaccggttaccccttaccggttaacccgaaccgttaggtttaccggttaacggttcccgtaacgggg

SEQ ID NO: 264835 - DNA, 320 bp, Homo sapiens
  misc_feature: GYAE6OF02FQIMJ.24.53.E09.1.454.CMB.1.raw
  modified_base (286)..(320): a, c, t, g, unknown or other
  misc_feature (286)..(320): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagcccaaggctgcccccctggtcactctgttccccaccctcctcaacatagtagtctgaggcgggtctggcaaggcgcaagtagnnnnnnnnnnnnnnnnnnnnnnnnnnnnnnnnnnn

SEQ ID NO: 264836 - DNA, 322 bp, Homo sapiens
  misc_feature: GYAE6OF02ICUVJ.24.53.E09.1.454.CMB.1.raw
  modified_base (297)..(322): a, c, t, g, unknown or other
  misc_feature (297)..(322): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggaggactaagctagaccgtctaggtcagcccaaggcctcgcccccgtacggtcacctcttcgttcccccaccctccacactatagtagtcgtgacggcggtctggacaaggcgctatacgnnnnnnnnnnnnnnnnnnnnnnnnnn

SEQ ID NO: 264837 - DNA, 291 bp, Homo sapiens
  misc_feature: GYAE6OF02IA2Q9.24.53.E09.1.454.CMB.1.raw
  modified_base (281)..(291): a, c, t, g, unknown or other
  misc_feature (281)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctcggtcactctgttccccacctcctcacatagtagtctgagcgggctggcaaggcgcatagnnnnnnnnnnn

SEQ ID NO: 264838 - DNA, 299 bp, Homo sapiens
  misc_feature: GYAE6OF02HJQ8I.24.53.E09.1.454.CMB.1.raw
  modified_base (259)..(259): a, c, t, g, unknown or other
  misc_feature (259)..(259): n is a, c, g, or t
  modified_base (288)..(299): a, c, t, g, unknown or other
  misc_feature (288)..(299): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtgattactactgccagtcgtacgaagatggttcggcggagggactaagctcgaccgtcctaggtcacgccctaaggctccgccccctggtcactctcgttcccgcccttccacatagtactntgagcggtccgtggccaaggctacatagnnnnnnnnnnnn

SEQ ID NO: 264839 - DNA, 313 bp, Homo sapiens
  misc_feature: GYAE6OF02JZUG2.24.53.E09.1.454.CMB.1.raw
  modified_base (285)..(285): a, c, t, g, unknown or other
  misc_feature (285)..(285): n is a, c, g, or t
  modified_base (291)..(313): a, c, t, g, unknown or other
  misc_feature (291)..(313): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggtgattactactgccagtcgtcgaagatgttcggcggagggactaagctgaccgtcctaggtcagcccaaggctcgccccctcggtacacctctcgttacccccaccctccctacaccgatagtagtctgagtcgggctggcaaggcncatagnnnnnnnnnnnnnnnnnnnnnnn

SEQ ID NO: 264840 - DNA, 504 bp, Homo sapiens
  misc_feature: GYAE6OF02FP1QN.24.53.E09.1.454.CMB.1.raw
  modified_base (162)..(162): a, c, t, g, unknown or other
  misc_feature (162)..(162): n is a, c, g, or t
  modified_base (183)..(183): a, c, t, g, unknown or other
  misc_feature (183)..(183): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (473)..(504): a, c, t, g, unknown or other
  misc_feature (473)..(504): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngcccccaaactcctcatttancgtaacaacaatcggccctctcggggtcccctgaccgattcctccgcctccaagtctggcacctcagcctgctggccatcatggcctcaggctgacgatgagggtnattactactgcccagtccgtagaacgatcggttcgggnggacggggacttaaaggcttacggacccgttccctagggtccacgacccctaaggcctcgcccccgttgtcactctccgtccccacccgtctccgatacgtagtacgtcagcgcgggtcacggganaacggcgcatagtgntncgnnnnnnnnnnnnnnnnnnnnnnnnnnnnnnnn

SEQ ID NO: 264841 - DNA, 299 bp, Homo sapiens
  misc_feature: GYAE6OF02G00XI.24.53.E09.1.454.CMB.1.raw
  modified_base (287)..(299): a, c, t, g, unknown or other
  misc_feature (287)..(299): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagcccaaggctcgccccctcggtcactctcgttccccgccctcctcacatagtagtctgaggcgggactggcaaggcgcatacgnnnnnnnnnnnnn

SEQ ID NO: 264842 - DNA, 640 bp, Homo sapiens
  misc_feature: GYAE6OF02J3KYX.24.53.E09.1.454.CMB.1.raw
  modified_base (584)..(584): a, c, t, g, unknown or other
  misc_feature (584)..(584): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (624)..(637): a, c, t, g, unknown or other
  misc_feature (624)..(637): n is a, c, g, or t
  modified_base (639)..(640): a, c, t, g, unknown or other
  misc_feature (639)..(640): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgccactggtacaagcagcttaccaaaacacgccccaaactcctcatttatcgtaaacaacaactcgccctcgtggggtccctgaccgattcctccgcctaccagtctcggcctacctcacgcctccgtactcggccacttcacgtgggccttcaggtctggacggtagtggtagggtgtacttaccgtaacgttcgacccgagttaccgtacgtaacggatttcgggtacggacgggtagggtaacttaacggctacgtaaccggttctaacgggtcaacggccccgtaaacggtcccgttaccggacccccggttcggttaacccgtacccttaccggtccgttccccccgtaccccttcccggtacctaacctagttaccggtactaccttcggggacggtcccgggtcggttccgggaaccttacggggacccgtagttaacgaacgtnatcagcagttnagtnacgnttnacttgctaaancncncgnnnnnnnnnnnnnncnn

SEQ ID NO: 264843 - DNA, 344 bp, Homo sapiens
  misc_feature: GYAE6OF02H50F7.24.53.E09.1.454.CMB.1.raw
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (288)..(289): a, c, t, g, unknown or other
  misc_feature (288)..(289): n is a, c, g, or t
  modified_base (291)..(344): a, c, t, g, unknown or other
  misc_feature (291)..(344): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgacgtcctaggtcagcccaaggctcgccccctggtcactctcgttcccaccctctcatatagatctgagcggctggcaaggctcatagnanncantncnganngnnnnnnnnnnnnnnnnnnnnnnnnnnnnnnnnnnnnnnnnnnnnnnnnnnnnnn

SEQ ID NO: 264844 - DNA, 500 bp, Homo sapiens
  misc_feature: GYAE6OF02G6PTW.24.53.E09.1.454.CMB.1.raw
  modified_base (112)..(112): a, c, t, g, unknown or other
  misc_feature (112)..(112): n is a, c, g, or t
  modified_base (244)..(244): a, c, t, g, unknown or other
  misc_feature (244)..(244): n is a, c, g, or t
  modified_base (362)..(362): a, c, t, g, unknown or other
  misc_feature (362)..(362): n is a, c, g, or t
  modified_base (447)..(448): a, c, t, g, unknown or other
  misc_feature (447)..(448): n is a, c, g, or t
  modified_base (450)..(450): a, c, t, g, unknown or other
  misc_feature (450)..(450): n is a, c, g, or t
  modified_base (457)..(500): a, c, t, g, unknown or other
  misc_feature (457)..(500): n is a, c, g, or t
tcagactactatgtcacgaccggtgctcgatttagagagagtgtgttggggtttggggagcaacatcggcgcaggttttgatgtccactggtacaagcagcttccaaaaacngccccccaaactcctcatttatcgtaacaacaatcggccctctcggggtcccctgaccgattcctccgcctccaagtctggcacctcagcctcgctggccatcactgggctccaggctgaggatggagggtnattactactgccagtcgtacggaagtattggttcgggacggtaggggactaagccgtacgtaccccgtccgtaaggtccgacgtacccgaagggcctcccggccccccgtcggtaccncctaccgtccgttcccccgcccctccctacactatagttcgtctggacgggcgggtcgtcggacggacggccggctaagtacgannanctgctgnnnnnnnnnnnnnnnnnnnnnnnnnnnnnnnnnnnnnnnnnnnn

SEQ ID NO: 264845 - DNA, 331 bp, Homo sapiens
  misc_feature: GYAE6OF02H00K5.24.53.E09.1.454.CMB.1.raw
  modified_base (175)..(175): a, c, t, g, unknown or other
  misc_feature (175)..(175): n is a, c, g, or t
  modified_base (300)..(331): a, c, t, g, unknown or other
  misc_feature (300)..(331): n is a, c, g, or t
tcagactactatgtcacgaccggtgctcgatttagagagagtgtgttgggtttgggggggtgtggtggtctccactcccgccttgacggggctgctatctgcctcgctggccatcactgggctccaggctgaggatgagggtgatttactactgcagtcgtcgaagatgttcggnggaggactaagctgaccgtccgtaggtcacgacccgaaggcctccggccccctggtcctaccttcgtccgttccccgccctcctcacattagtagtctgaggcggccgtaggcgaggcgcatagnnnnnnnnnnnnnnnnnnnnnnnnnnnnnnnn

SEQ ID NO: 264846 - DNA, 705 bp, Homo sapiens
  misc_feature: GYAE6OF02HMBO6.24.53.E09.1.454.CMB.1.raw
tcagactactatgtcacgaccggtgctcgatttagagagagtgtgttgggtttgggaggcttggtccagcctggggggtccctgagactctcctgtgcagcctctggattcccctttagtgactttttggatgacctgggtccgccaggctccgaggggacggggctgggagtggggtggccaatagtaaggcacgatggacgtagcatgtactatgtggactctgtggaaggccgattccacatctccagagacaacgcccagaactcactgtatcgtaggaaatcgaccacgcctagagcgtacgaggacacggctagtgttaattactggtcgcgactatactcagccactggacgtcgctactctagtaactacctcagcgtacgtcggggccagggcctaacccgtcggtacccgtcccgttccgtccctcgaccgtaccctacccgaacccggtaaccgggacccctaacggttaccccggtttccccttacccccggtcggtccccgtaccccgtccggtcccgtacccggaaccggtaccgcccgtaccccgtccggaacgaccggacccgaaccgtaccggtcccgggaccccgggttcgggtaccgttccggtcccggttacgggtaaaccgtaaccggttacccgttacccttacccgaacgttaaccgtttacggttaccggtagtaccgggg

SEQ ID NO: 264847 - DNA, 725 bp, Homo sapiens
  misc_feature: GYAE6OF02JLJMI.24.53.E09.1.454.CMB.1.raw
  modified_base (279)..(279): a, c, t, g, unknown or other
  misc_feature (279)..(279): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (712)..(712): a, c, t, g, unknown or other
  misc_feature (712)..(712): n is a, c, g, or t
  modified_base (724)..(724): a, c, t, g, unknown or other
  misc_feature (724)..(724): n is a, c, g, or t
tcagactactatgtcacgaccggtgctcgatttagagagagtgtgttgggtttgggggctgtttttggagctgcttgtaccagagggtcaccatctcctgcactgggagcaacatcggcgcaggttttgactgtccactggtacaagcagcttaccaaaaccacgacccccaaactcctctatttagtacgtaaacaacaagtccggcccttacgtcgggggtccctacggtaccgtactttcctcccgaccctccgaaagttcctcggacctaccctnacgtcccttccgctcggtacccatccaccggttcgggcctacccggaggcttacgggaaggtactagggacgggttatacttactacgtcgacgtaacgtcggtaacgaaggttgtaccggtttccggggaacggaaggggtaaacctacggtccgtcggtaaccccgttacggtaacgggtccaaacggtaccccggattaccgggccccttacccccggtacggttaccaacggttcccgttaccgtttccccccacccgttaccgtacaaaccgttacggttaagtccggtttaccgagggacccgggttcgggacgttacgggaacgtaccgggaccgtacaacgtcggctagcctgtaccngctacacncgngactacgtacgtcacacgtcgcgacgtcgacgtgacgtacactagtagtacgcgtntagtctacgagng

SEQ ID NO: 264848 - DNA, 972 bp, Homo sapiens
  misc_feature: GYAE6OF02G0P49.24.53.E09.1.454.CMB.1.raw
  modified_base (441)..(441): a, c, t, g, unknown or other
  misc_feature (441)..(441): n is a, c, g, or t
tcagactactatgtcacgaccggtgctcgatttagagagagtgtgttgggtttgggggctgttttggtacgactgctgtaccagaggtcaccatcgtccgtcgcactggagcaacagtcgtcgcagtttcgatgtcctacgtcggtaacaagcaagtacttaccaaaaacgacaccccctaacctacctacctatttactacggttaaccaaccaattcccggtcccttccgttacggggtaccccgtggtaacccgttactttccgttaccggtacccgtacccaacggttacttaccggggcctaaaccccttccgaacggtcccgtaccggtcgtaccggggacccacttaaccgccgttaggggccttaccccacgggtaacgtcgggttaaggggtaattaccgggaggggttaaccggtatttaaccggttaacncgggacccggacgttacccggttaccggggtaaagtacgttcggtttacccgggaccggggagggggttaaacctaccgggtccgttttacgaaccccgggttccggtttaaaacggggttcccggtaccgggtaaacccccgaaggggtaaccctttacccggcccccccgggtttcggggttaccccaacggttccgtttaaccgggtttcccccccggttaacccgttccccgttaacccggacccttaaaaaggtttcccgggttttaaaacttttacccggggtaaccccgtttaacggggacccccgggggttttaaggtacccggggtaaacgggtaacccggggttaaacccgcgggggttaaaacgtaaaccggggttcctacgggttttaaccctccgggttaacttacccttgttaaccgtacgtactaacgtaccgtacgttactactactctactacgttacgcggtacggaacgtacgtacgtagtacgtaacgtagtacgtcgtagtcgtactgcc

SEQ ID NO: 264849 - DNA, 316 bp, Homo sapiens
  misc_feature: GYAE6OF02IWIJM.24.53.E09.1.454.CMB.1.raw
  modified_base (228)..(228): a, c, t, g, unknown or other
  misc_feature (228)..(228): n is a, c, g, or t
  modified_base (289)..(316): a, c, t, g, unknown or other
  misc_feature (289)..(316): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgcctagtcgtcgaagatgttcggcggagggactaagctgaccgtcgtaggtcagcccaaggctcgcccctcggtcnctctcgtcccgccctcctcactatagtgtctgaggcggcgtcggacgaggccgactatagnnnnnnnnnnnnnnnnnnnnnnnnnnnn

SEQ ID NO: 264850 - DNA, 475 bp, Homo sapiens
  misc_feature: GYAE6OF02F0OHO.24.53.E09.1.454.CMB.1.raw
  modified_base (209)..(209): a, c, t, g, unknown or other
  misc_feature (209)..(209): n is a, c, g, or t
  modified_base (447)..(475): a, c, t, g, unknown or other
  misc_feature (447)..(475): n is a, c, g, or t
tcagactactatgtcacgaccggtgctcgatttagagagagtgtgttgggtttgggggctgtttttggaagctgcttgtaccagaggggtcaccatctcctgcactgggagcaacatcggcgcaggttttgatgtccactggtacaagcagcttccaaaaaacagccccccaaaactccctcatttatcgtaaacaacaatcggccctntcggggtccctgaccgattctccgccctccaagtctggccacctcagcctcgctggccatccactgggctccaggctgaggatgaggggtgattactactgccagtcgtcgaagatggttcgggcggagggactaaagctgaccgtcctaggtcagcccaaggctcgcccccgtcggtcactctcgttcccgccctcctcacatagtagctgacgcgggctgggcaacggcgcatagnnnnnnnnnnnnnnnnnnnnnnnnnnnnn

SEQ ID NO: 264851 - DNA, 499 bp, Homo sapiens
  misc_feature: GYAE6OF02HQOZG.24.53.E09.1.454.CMB.1.raw
  modified_base (162)..(162): a, c, t, g, unknown or other
  misc_feature (162)..(162): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (466)..(499): a, c, t, g, unknown or other
  misc_feature (466)..(499): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaaatcctcatttatcgtaaacaacaatccggccctcgtggggtccctgacccgattcctacccgcctccaaagtctggccacctcagccctcgctggccatccactgggcctccaggctggacggatgagggtgattactacgtgccctagtcggtacgaaagaatggtttcgggacggaggggtactaaaggctacggacccgtctaggtcaagccccaaggcctcgcccctggtcactctcgtcccnccctctcacatagtagtctgacgcgggctgacaggcgnacgtagnannnnnnnnnnnnnnnnnnnnnnnnnnnnnnnnnn

SEQ ID NO: 264852 - DNA, 668 bp, Homo sapiens
  misc_feature: GYAE6OF02G4RJA.24.53.E09.1.454.CMB.1.raw
  modified_base (162)..(162): a, c, t, g, unknown or other
  misc_feature (162)..(162): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (327)..(327): a, c, t, g, unknown or other
  misc_feature (327)..(327): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (643)..(647): a, c, t, g, unknown or other
  misc_feature (643)..(647): n is a, c, g, or t
  modified_base (649)..(651): a, c, t, g, unknown or other
  misc_feature (649)..(651): n is a, c, g, or t
  modified_base (653)..(660): a, c, t, g, unknown or other
  misc_feature (653)..(660): n is a, c, g, or t
  modified_base (662)..(668): a, c, t, g, unknown or other
  misc_feature (662)..(668): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacncgcccccaaactcctcatttatcgtaaacaacaatccggcctcgtggggtccctgaccgtattccncccgtccnccaagtcctggccaccctnacgtcctccgcttcggccctaagttccacgtcggggccttccgacggtctcggaaggtagtgggaggggttntaactttacctaaccggtggtaccccgaggttccggtacggaaagtacgttcgggtttccggggacggggtaacggtaacgtaaccggcgttacgtaccccgggttacccgtagggtacctacgaccccgtaagggtcccgttccggcccccgttacgggtccctacgtttccgttcccggttacccccgcccttaccgtcccgaaccgtacgttaacggttacggttaccgtgggaaccgggtccggggtaccgtacggggaccgtaacggggccgtaaccaggttaaccggntacgngctncgcagtgcaagcnnnnngnnncnnnnnnnncnnnnnnn

SEQ ID NO: 264853 - DNA, 437 bp, Homo sapiens
  misc_feature: GYAE6OF02GZW5K.24.53.E09.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
  modified_base (404)..(437): a, c, t, g, unknown or other
  misc_feature (404)..(437): n is a, c, g, or t
tcagactactatgtcacgaccggtgctcgatttagagagagtgtgttggggtttgggagcaaacatcggcgcaggttttgatgtccactggtacaagcagcttccaaaaaacagccccccaaaactccctcatttatcgtaacaacaaatcggcccctctggggtccctgaccgattctccgcctccaagtctgcacctcagcctcgctggccatcactgggctccaggctgagntgaggtnattacactgccagtcgtacgaagntggttcggcggaggactaagctacgacccgtcgtaggtccagcccaaggcctcgcccccgtcgtccactctcgtcccacctccncacatacgttatctgagcgggcgtcggacgaaggcgacgatacggangcagtcnnnnnnnnnnnnnnnnnnnnnnnnnnnnnnnnnn

SEQ ID NO: 264854 - DNA, 620 bp, Homo sapiens
  misc_feature: GYAE6OF02FJO3D.24.53.E09.1.454.CMB.1.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (555)..(555): a, c, t, g, unknown or other
  misc_feature (555)..(555): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(578): a, c, t, g, unknown or other
  misc_feature (576)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (619)..(619): a, c, t, g, unknown or other
  misc_feature (619)..(619): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacacgcccccaaactcctcatttatacgtaaacaacaactccggccctctcgggtccctgaccgattccnccgcctccaagtctggccacctcacgcctcgcttcggaccatcacgttcggcctccgaggctggaggtagtggagggttnactttaccactcgcctacgtccgtagaagtagttcggtcgggacggacgggacgtaacggctaccggtacccgttaccgtaggtaccgaaccggtcccgaacggtccgtaccgtccccccggtggttccctaccttccgttaccgttccccccgtaccctccctaccgtaacctacgttaacggtacgtcgtacgggaccggcggggtctacggggaacgtaaccggcgaccgtaagtcggactnacggctcgacgnngngngncnnncncngcgcncgngtcncngcgancgtgcgcncncgtgcgtnc

SEQ ID NO: 264855 - DNA, 815 bp, Homo sapiens
  misc_feature: GYAE6OF02IARKQ.24.53.E09.1.454.CMB.1.raw
  modified_base (166)..(166): a, c, t, g, unknown or other
  misc_feature (166)..(166): n is a, c, g, or t
  modified_base (726)..(726): a, c, t, g, unknown or other
  misc_feature (726)..(726): n is a, c, g, or t
  modified_base (749)..(749): a, c, t, g, unknown or other
  misc_feature (749)..(749): n is a, c, g, or t
  modified_base (757)..(757): a, c, t, g, unknown or other
  misc_feature (757)..(757): n is a, c, g, or t
  modified_base (761)..(761): a, c, t, g, unknown or other
  misc_feature (761)..(761): n is a, c, g, or t
  modified_base (768)..(768): a, c, t, g, unknown or other
  misc_feature (768)..(768): n is a, c, g, or t
  modified_base (794)..(794): a, c, t, g, unknown or other
  misc_feature (794)..(794): n is a, c, g, or t
  modified_base (807)..(807): a, c, t, g, unknown or other
  misc_feature (807)..(807): n is a, c, g, or t
  modified_base (814)..(814): a, c, t, g, unknown or other
  misc_feature (814)..(814): n is a, c, g, or t
tcagactactatgtcacgaccggtgctcgatttagagagagtgtgttgggtttgggggctgtttttggaagctgcttgtaccagagggtcaccatcctcctgcactgggagcaacatcggcgctaggttttgatgtccacgtggtacaagcagcttaccaaaaacncgcccccaaatcctctatttacgtcgtaaacaactaagtccggtccctcgtacggggtccccttaggacccgtaatttcccgtcccgcccttaccgaacggttcctcgggtaccctaccccttacaaccgggtcccttccgggcccttcggggaccccctaagttcccgaacggttccggggtcccttacccgtaaccgggttcctacgggtaacggtacgttcgggtaaggggtttacggtaaaactttaccgttaaccgttacggtcccggtaaacggttaccggttaaccgtaaagggtaactttcgggttttaccggggacccggggtaaggggtaaacccgttaaacggccgtttaaccggaacccgggttacccgttacgggttacccaacgtacccggtaaacggtcccgttacccggtaccccggttacggttaccctacccgttccggtttacccgttccccggtacccttacccgtacctaccgtagtaacgttacggtccgttgggaccggtcgggtcgacgggtacgaccggtccgtacgagttacgngctaggctacagtcagtcgactnccggtaanccgnttacggntactcgtgcgtacgtcgtcgtcgtanacgtagtcgctcngcgtgtnc

SEQ ID NO: 264856 - DNA, 291 bp, Homo sapiens
  misc_feature: GYAE6OF02HHS1J.24.53.E09.1.454.CMB.1.raw
  modified_base (261)..(261): a, c, t, g, unknown or other
  misc_feature (261)..(261): n is a, c, g, or t
  modified_base (286)..(291): a, c, t, g, unknown or other
  misc_feature (286)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggaggtgattactactgccagtcgtcgaaagatgttcggcggagggactaagctgaccgtcctaggtcagcccaaggctcgccccctggtcactctcgttccccaccttcctcactatagtagtcnggagcgggctggcaaggcgcatagnnnnnn

SEQ ID NO: 264857 - DNA, 293 bp, Homo sapiens
  misc_feature: GYAE6OF02FZFVZ.24.53.E09.1.454.CMB.1.raw
  modified_base (288)..(293): a, c, t, g, unknown or other
  misc_feature (288)..(293): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccgccctcctcacatagtacgtctgaggcgggtctggcaaggccgcatagnnnnnn

SEQ ID NO: 264858 - DNA, 290 bp, Homo sapiens
  misc_feature: GYAE6OF02GR7OR.24.53.E09.1.454.CMB.1.raw
  modified_base (262)..(262): a, c, t, g, unknown or other
  misc_feature (262)..(262): n is a, c, g, or t
  modified_base (284)..(290): a, c, t, g, unknown or other
  misc_feature (284)..(290): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatggttcggcggagggactaagctgaccgtcctaggtcagcccaaggcctcgcccctcggtcactctcgtccccaccctcctcacatagtagtcagngcgggctggcaaggcgcatagnnnnnnn

SEQ ID NO: 264859 - DNA, 435 bp, Homo sapiens
  misc_feature: GYAE6OF02G3FSI.24.53.E09.1.454.CMB.1.raw
  modified_base (162)..(162): a, c, t, g, unknown or other
  misc_feature (162)..(162): n is a, c, g, or t
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (421)..(435): a, c, t, g, unknown or other
  misc_feature (421)..(435): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttccaaaaacngccccccaaactcctcatttatcgtaacaacaatcggccctctggggtccctgaccgattctccgcctccaagtctggcacctcagcctcgctggccatcactgggctccgaggctgaggatgagggtgattactactgccagtcgtacgaagntgtcggcggaggactagctagaccgtctaggtcagcccgaaggctcgcccctgcactctcgtcccncctcncacntagacgtcngacgcggntgacaggcnatgnnnnnnnnnnnnnnn

SEQ ID NO: 264860 - DNA, 504 bp, Homo sapiens
  misc_feature: GYAE6OF02G4E4G.24.53.E09.1.454.CMB.1.raw
  modified_base (165)..(165): a, c, t, g, unknown or other
  misc_feature (165)..(165): n is a, c, g, or t
  modified_base (334)..(334): a, c, t, g, unknown or other
  misc_feature (334)..(334): n is a, c, g, or t
  modified_base (479)..(504): a, c, t, g, unknown or other
  misc_feature (479)..(504): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagccttaccaaaaaacncgaccccccaaaactccctctattttatcgtaaacaacaatccggccctctcggggtcccctgaccgtattcctcccgccctccaagtcctggccacctcagccctcgctggccatccactggctccaggctgaggatggaggtgattacactgccagtcgtacgaagntggtcgggcggaggactaggctcggacccgtcctaggtccacggcccaaggtctccgcccccgtgcctactcttccgttcccccaccctcctcactatacgttagtcgtgacggcgggtctagggacgaacgggcaccgatagcnnnnnnnnnnnnnnnnnnnnnnnnnn

SEQ ID NO: 264861 - DNA, 291 bp, Homo sapiens
  misc_feature: GYAE6OF02FNX09.24.53.E09.1.454.CMB.1.raw
  modified_base (285)..(291): a, c, t, g, unknown or other
  misc_feature (285)..(291): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgttccccaccctcctcacatagtagtctgaggcgggctggcaaggcgcatagnnnnnnn

SEQ ID NO: 264862 - DNA, 682 bp, Homo sapiens
  misc_feature: GYAE6OF02JVHLH.24.53.E09.1.454.CMB.1.raw
  modified_base (167)..(167): a, c, t, g, unknown or other
  misc_feature (167)..(167): n is a, c, g, or t
  modified_base (325)..(325): a, c, t, g, unknown or other
  misc_feature (325)..(325): n is a, c, g, or t
  modified_base (379)..(379): a, c, t, g, unknown or other
  misc_feature (379)..(379): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (649)..(653): a, c, t, g, unknown or other
  misc_feature (649)..(653): n is a, c, g, or t
  modified_base (655)..(655): a, c, t, g, unknown or other
  misc_feature (655)..(655): n is a, c, g, or t
  modified_base (657)..(659): a, c, t, g, unknown or other
  misc_feature (657)..(659): n is a, c, g, or t
  modified_base (661)..(682): a, c, t, g, unknown or other
  misc_feature (661)..(682): n is a, c, g, or t
tcagactactatgtcacgaccggtgctcgatttagagagagtgtgttgggtttgggggctgttttggaagctgcttgtaccagagggtcaccatctcctgcacgtgggagcaacatcggcgctaggttttgatgtccacgtaggtacaagcagcttaaccaaaaacncgaccccccaaactcctactaatttataccgtaaacaacaacgtccggacccttcgtccggggtcccctaggaacccgtacttccctcccggacccttaccgaaggttccgtcggcctaacccgttcaccgccctcggtccgtcggtacccattaccncggttcgggacccttccggaaggccgtagggaaggtacgttagggtacggggtnttaaactttcccgtaacggtccgccgtaaggttcccgtaaggtaagtacggttcgggttccggggaacggtacgggaacgttaccgcgtaccggtaccccgtttaccggtacggtaccgtaccggacccggtaccggttcccgtccccgtacccggttaccgtccctaccgttcccgtccccttaacccccgcccttagacccgttagtacgtcgggaccgttggccgggaccggttcgaggtaccgacgacgtccagtacgntnangannnnngncnnngnnnnnnnnnnnnnnnnnnnnnn

SEQ ID NO: 264863 - DNA, 523 bp, Homo sapiens
  misc_feature: GYAE6OF02IMW1G.24.53.E09.1.454.CMB.1.raw
  modified_base (162)..(162): a, c, t, g, unknown or other
  misc_feature (162)..(162): n is a, c, g, or t
  modified_base (334)..(334): a, c, t, g, unknown or other
  misc_feature (334)..(334): n is a, c, g, or t
  modified_base (495)..(495): a, c, t, g, unknown or other
  misc_feature (495)..(495): n is a, c, g, or t
  modified_base (497)..(523): a, c, t, g, unknown or other
  misc_feature (497)..(523): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngccccccaaactccctcattttatcgtaaacaacaatcggccctctggggtccctgacccgattcctccgccttccaagtctggccaccctcacgccctcgcctggccatcactgggccttccaggctgaggatggagggttacttactacgtcgccgagttcggtcgaagnttggttcggagggaggtactaagcgttcgaccgtcgtaggcacgacccgaagccgtcgtcccccgttgtcctaccttcctaccgtttccccaccccttcccgcaacgtcttacggtactctacggtacggccggtgttacggaccagggacgtcaagtagnannnnnnnnnnnnnnnnnnnnnnnnnnn

SEQ ID NO: 264864 - DNA, 386 bp, Homo sapiens
  misc_feature: GYAE6OF02HTP3U.24.53.E09.1.454.CMB.1.raw
  modified_base (307)..(311): a, c, t, g, unknown or other
  misc_feature (307)..(311): n is a, c, g, or t
  modified_base (313)..(386): a, c, t, g, unknown or other
  misc_feature (313)..(386): n is a, c, g, or t
tcagactactatgtcacgaccggtgctcgatttagagagagtgtgttgggtttgggggggtgtggtggtctccactcccgccttgacggggctgctatctgcctcgctggccatcactgggctccaggctgaggatgagggtgattactactgccagtcgtcgaagatggttcggcggaggactaagctgaccgtcctaggtcacgacccgaaggcctacgcccccgttcggtacacttcctccgttaccccacccctcctccaacattagtagtctggacgcgggctggaacgaaggcgacagtannnnnannnnnnnnnnnnnnnnnnnnnnnnnnnnnnnnnnnnnnnnnnnnnnnnnnnnnnnnnnnnnnnnnnnnnnnnnn

SEQ ID NO: 264865 - DNA, 300 bp, Homo sapiens
  misc_feature: GYAE6OF02I9WO8.24.53.E09.1.454.CMB.1.raw
  modified_base (285)..(300): a, c, t, g, unknown or other
  misc_feature (285)..(300): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcacgcccaaggcctcgccccctcggtcactctcgttccccgccctcttcacatagtagtctgagcgggctggcaaggcgcatagnnnnnnnnnnnnnnnn

SEQ ID NO: 264866 - DNA, 761 bp, Homo sapiens
  misc_feature: GYAE6OF02HY6IW.24.53.E09.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (556)..(556): a, c, t, g, unknown or other
  misc_feature (556)..(556): n is a, c, g, or t
  modified_base (677)..(677): a, c, t, g, unknown or other
  misc_feature (677)..(677): n is a, c, g, or t
  modified_base (697)..(697): a, c, t, g, unknown or other
  misc_feature (697)..(697): n is a, c, g, or t
  modified_base (723)..(723): a, c, t, g, unknown or other
  misc_feature (723)..(723): n is a, c, g, or t
  modified_base (738)..(738): a, c, t, g, unknown or other
  misc_feature (738)..(738): n is a, c, g, or t
  modified_base (749)..(749): a, c, t, g, unknown or other
  misc_feature (749)..(749): n is a, c, g, or t
  modified_base (757)..(757): a, c, t, g, unknown or other
  misc_feature (757)..(757): n is a, c, g, or t
tcagactactatgtcacgaccggtgctcgatttagagagagtgtgttgggtttgggggctgtttttggaagctgcttgtaccagaggtcaccatctcctgcactgggagcaaacatcggcgcaggttttgatgccactggtacaagccagtcttaaccgaaaaacnccgacccctaaactcctcatttanacgtaacaacaagtccgcctcgtgggtccctgaccgtattcnccgctacaagtctggcncctacgcgtcctcgngtcgacacgtacgtcgtgggtccncgacggnttaggaagagtcgggtaggtagtaacgtttacgtacgacgtcgtacggtaccgttagaaacggtggttcggttaccgggacgggacgggtaaactaaaccggtcggtaaccggtaacccggttccggtaacggttacccgtaaacccggacccgtttaaacggggcccgttaaccccggtaccccccgggtttaacggttaccttaacccggttcccgttttaacccccggggtttcccccctaaaccctaaccccgtttnaaacccttaggttaacggttacccgtttagggtacccggggttaacgggcccccggggttagtaaccggaacccgggtaaaacggggcccgtaacccggaaagtttaaacgggcacgtacncgacgacgacgtgtactacncgcgcacagcgacgtactactatacngtctctgtcgtacancgtccgtccgngtacactntacg

SEQ ID NO: 264867 - DNA, 693 bp, Homo sapiens
  misc_feature: GYAE6OF02IO233.24.53.E09.1.454.CMB.1.raw
  modified_base (111)..(111): a, c, t, g, unknown or other
  misc_feature (111)..(111): n is a, c, g, or t
  modified_base (386)..(386): a, c, t, g, unknown or other
  misc_feature (386)..(386): n is a, c, g, or t
  modified_base (455)..(455): a, c, t, g, unknown or other
  misc_feature (455)..(455): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (625)..(626): a, c, t, g, unknown or other
  misc_feature (625)..(626): n is a, c, g, or t
  modified_base (630)..(630): a, c, t, g, unknown or other
  misc_feature (630)..(630): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
tcagactactatgtcacgaccggtgctcgatttagagagagtgtgttgagtttggggctgtttttggaagctgcttgtaccagagggtcaccatctcctgcactggggacncaacatcggcgctaggttttgatgtccacgtggtacaaggcagccttaccaaaaacacgacccccaaactcctactatttacgtacgtaaacaacaatccggcccttcgtcggggtccctaggtaccgtattccgtcccgcctccgtaagtctcggctacctacgacgtcctcgacgtggccctaatccaccggtggacctaccgagggtcctaggaggtagttaggacgggtagtactttaacctacgttcgacctaggtacgtacgaaggttnttacgtcggacggggagtaatacggcgtacgtaccggtacgttaggtaccaacgacccgaaaggttccncccgggttaacccccctcgggttacctaaactttcccgtttaccccgtaccccgtaaccccttacgttcccaaacgttaacgtacggttaccgtaaccgtgggtaccggagggttcccaggggacccgttacgggacgtacgtaaggtacncgctngntacgcacgcgannacgngacacgatagtctacgagtcgagtacanacgtntacgactcgtagacgtacgtacgtcgtacg

SEQ ID NO: 264868 - DNA, 777 bp, Homo sapiens
  misc_feature: GYAE6OF02JRCW9.24.53.E09.1.454.CMB.1.raw
  modified_base (166)..(166): a, c, t, g, unknown or other
  misc_feature (166)..(166): n is a, c, g, or t
  modified_base (341)..(341): a, c, t, g, unknown or other
  misc_feature (341)..(341): n is a, c, g, or t
  modified_base (697)..(697): a, c, t, g, unknown or other
  misc_feature (697)..(697): n is a, c, g, or t
  modified_base (711)..(711): a, c, t, g, unknown or other
  misc_feature (711)..(711): n is a, c, g, or t
  modified_base (717)..(717): a, c, t, g, unknown or other
  misc_feature (717)..(717): n is a, c, g, or t
  modified_base (748)..(748): a, c, t, g, unknown or other
  misc_feature (748)..(748): n is a, c, g, or t
tcagactactatgtcacgaccggtgctcgatttagagagagtgtgttgggtttgggggctgtttttggaagctgcttgtaccagagggtcaccatctcctgcactgggagcaacagtcggcgactaggttttgatgtccactggtacaagcagcttaccaaaaacncgcccccaaactcctactatttactacgtaaacaacaactccggcccttcgtcggggtccctcgaccgtattcctcccgcctaccaagttctacggcacctcacgcctcgacgtcggacctatccacgtcgggacctccgtaggcctaggaagggtacgttaggtaacggggttnttaactttacgtaaccgtcggaaccgttacggtaccggttaacggtaaaagtccgggtttaggttaccggggaacgggggtaacggtaaaaccgttagtcccggttaacggtaacccccggtttaaccgtaacggggttaccgaaccggtaccccgtaaaggggtccccgtttacccccgggccccccgtttaacgggttaacccttaaccgtttccccgttttaacccgggtccccccttaaacccccttccgttaaccgaacccgtttaagttacggttacgttacctacgggtaaccgggtccggggtaacgtacgggaccggtaacggaccggtactaacggttacacggcncgcatcgacactanacgacngagtacgcgtacgcgtagcgacgacgagcanacacgacgtgctcgcgatactcgtacacg

SEQ ID NO: 264869 - DNA, 566 bp, Homo sapiens
  misc_feature: GYAE6OF02HG1EZ.24.53.E09.1.454.CMB.1.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (470)..(470): a, c, t, g, unknown or other
  misc_feature (470)..(470): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
  modified_base (532)..(542): a, c, t, g, unknown or other
  misc_feature (532)..(542): n is a, c, g, or t
  modified_base (544)..(566): a, c, t, g, unknown or other
  misc_feature (544)..(566): n is a, c, g, or t
tcagactactatgtcacgaccggtgctcgatttagagagagtgtgttgggtttgggggctgtttttggaagctgcttgtaccagagggtcaccatcctcctgcactgggagcaacatcggcgcaggttttgatgtccactggtacaagcagcttaccaaaaacncgacccccaaatcctntatttatccgtaacaacaatccggtccctgtcgggtcccngaccgattcnccgcctacgaattcnggccacctcacgtcctcgtcgtcggacctacncctacgcgggacctccgaggtccgtaggtacgagttcgggagggttcaaactttcgtacgtcgaccgtagttccggacgaagtacgttggtccgggacgggtacgggaaagtagccgtaccgtaccggtcccgtaggtaccacggacccgacggtccgtcccgtccccgacgttcacttccccgtcttccccnccctcgtacactagtactacgtcgtacgngggcccggtntcggaacgacgtcgactacggtnnnnnnnnnnncnnnnnnnnnnnnnnnnnnnnnnn

SEQ ID NO: 264870 - DNA, 719 bp, Homo sapiens
  misc_feature: GYAE6OF02I1VZD.24.53.E09.1.454.CMB.1.raw
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
tcagactactatgtcacgaccggtgctcgatttagagagagtgtgttgggtttggggaggcttggtccagcctggggggtccctgagactctcctgtgcagcctctggattcccctttagtgacttttggatgaccgtggtccgccaggctccagggacgggctggagtgggtggccaatataaggcacgatggactgcatgtactntgtgactntgtgaaggcgattcaccatctccagacgacacgcccagaacctcactntactcgtagaaatcgaccagcccgtagaacgngtcgaggtacacggtctagtcgtaattacctggtcgtaccggtaacctaattactccgtaaacggccctaacgtcggggaacgttcccgatacgttaccgttagtaaccggttaaccttacccgaagtaccgtacggttcggggacccgtacggggacctacccgttccgggtaacctcccggttaccgtaccctccgaaccgtccctacccgaaccggtacccggtaccctcgttacccggtaccctttccccggacggtcccgtcccggtacgtccttaccggacgggtccgaccgacccggtaaccgacggtaacaccggtaccgtacggcccggtaccgtcggtccgtcggtccgttacggtacccgtaacggtacccttacgttacccgaagttacgtaacgttaccggtccgtagggg

SEQ ID NO: 264871 - DNA, 369 bp, Homo sapiens
  misc_feature: GYAE6OF02GPYNB.24.53.E09.1.454.CMB.1.raw
  modified_base (292)..(292): a, c, t, g, unknown or other
  misc_feature (292)..(292): n is a, c, g, or t
  modified_base (313)..(369): a, c, t, g, unknown or other
  misc_feature (313)..(369): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtacgaagatgttcggcggaggactaagctgaccgtccgtaggtcacgacccaaggcctcgcccccctcggtccactcttccgttcccccacccctcctcactataggtacgtctggaggtccgggctacggngtaaacgggcgactaagtgannnnnnnnnnnnnnnnnnnnnnnnnnnnnnnnnnnnnnnnnnnnnnnnnnnnnnnnn

SEQ ID NO: 264872 - DNA, 496 bp, Homo sapiens
  misc_feature: GYAE6OF02GUDHB.24.53.E09.1.454.CMB.1.raw
  modified_base (164)..(164): a, c, t, g, unknown or other
  misc_feature (164)..(164): n is a, c, g, or t
  modified_base (346)..(346): a, c, t, g, unknown or other
  misc_feature (346)..(346): n is a, c, g, or t
  modified_base (474)..(474): a, c, t, g, unknown or other
  misc_feature (474)..(474): n is a, c, g, or t
  modified_base (481)..(496): a, c, t, g, unknown or other
  misc_feature (481)..(496): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacngccccccaaatcctcatttatcgtaacaacaatcggccctgtcggggtccctgaccgattcctccgcctccaagtctggccacctcgacgcctcgctggcccatccacgtgggcctccgaggctggacggatggaggtgatttactactgcctaggtcgtacgaagtagttggttccggggngggaagggactaaggctcggaccgtcgtaggtcacgacccgaagcctccgccccgtgctactctccgttccccaccctcctacactactacgtacgtctggacggcgggtctggacgtaacggcgtanagtgctnnnnnnnnnnnnnnnn

SEQ ID NO: 264873 - DNA, 418 bp, Homo sapiens
  misc_feature: GYAE6OF02F78YS.24.53.E09.1.454.CMB.1.raw
  modified_base (111)..(111): a, c, t, g, unknown or other
  misc_feature (111)..(111): n is a, c, g, or t
  modified_base (133)..(133): a, c, t, g, unknown or other
  misc_feature (133)..(133): n is a, c, g, or t
  modified_base (240)..(240): a, c, t, g, unknown or other
  misc_feature (240)..(240): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (391)..(418): a, c, t, g, unknown or other
  misc_feature (391)..(418): n is a, c, g, or t
tcagactactatgtcacgaccggtgctcgatttagagagagtgtgttgggtttgggagcaacatcggcgcaggttttgatgtccactggtacaagcagcttccaaaaaacngtccccaaaactcctcatttancgtaacaacaatcggccctctggggtccctgaccgattctccgcctccaagtctggcacctcagccctcgctggccatcactgggctccaggctgaggatgagggtnattactactgccagtcgtacgaaagatggttcggcggagggactaagctgaccgtcctaggtcagcccaaaggctacgccccctcggtcactctcgttccccaccctcctcactatagtagtctgagcggntggacaaggcgcatacgngnnnnnnnnnnnnnnnnnnnnnnnnnnnn

SEQ ID NO: 264874 - DNA, 313 bp, Homo sapiens
  misc_feature: GYAE6OF02GJS8B.24.53.E09.1.454.CMB.1.raw
  modified_base (290)..(313): a, c, t, g, unknown or other
  misc_feature (290)..(313): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcacgcccaaggctcgccccctcggtcactcctcgttcccccaccctcctcacatagtagtctgagcgggctggcaaggtcgccataggnnnnnnnnnnnnnnnnnnnnnnnn

SEQ ID NO: 264875 - DNA, 647 bp, Homo sapiens
  misc_feature: GYAE6OF02F4DOY.24.53.E09.1.454.CMB.1.raw
  modified_base (163)..(163): a, c, t, g, unknown or other
  misc_feature (163)..(163): n is a, c, g, or t
  modified_base (317)..(317): a, c, t, g, unknown or other
  misc_feature (317)..(317): n is a, c, g, or t
  modified_base (610)..(612): a, c, t, g, unknown or other
  misc_feature (610)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (620)..(621): a, c, t, g, unknown or other
  misc_feature (620)..(621): n is a, c, g, or t
  modified_base (623)..(638): a, c, t, g, unknown or other
  misc_feature (623)..(638): n is a, c, g, or t
  modified_base (640)..(644): a, c, t, g, unknown or other
  misc_feature (640)..(644): n is a, c, g, or t
  modified_base (646)..(647): a, c, t, g, unknown or other
  misc_feature (646)..(647): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacncgacccccaaactcctcattttactcgtaaacaacaatccggccctcgtcggggtccctgaccgtattcctccgcctccaagtctggaccacctcacgccctcgctcggccatcacgtcgggcctaccgaggcctggaacggtagtggagggtntaacttactacgtcgaccgtacggtcgtacgaagtacgttcggttaccggggacgggaacgggtaacgtaacgtccgtaccggtaaccccggttccgttaacgggtacaacccgggtacccgaaacggggtcccttacccggtcccccccggtttacggtacccgtacttcccgtttccggttacccccctacccccttccgtacccaactacgtttaacggtacgtccgttagggaccggccgggtccgtacgggaccgaacggtcccggtacgttaacgagcgtatcgagnnncncncacnncnnnnnnnnnnnnnnnncnnnnncnn

SEQ ID NO: 264876 - DNA, 679 bp, Homo sapiens
  misc_feature: GYAE6OF02G7NXM.24.53.E09.1.454.CMB.1.raw
  modified_base (162)..(162): a, c, t, g, unknown or other
  misc_feature (162)..(162): n is a, c, g, or t
  modified_base (620)..(620): a, c, t, g, unknown or other
  misc_feature (620)..(620): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (662)..(667): a, c, t, g, unknown or other
  misc_feature (662)..(667): n is a, c, g, or t
  modified_base (669)..(670): a, c, t, g, unknown or other
  misc_feature (669)..(670): n is a, c, g, or t
  modified_base (672)..(673): a, c, t, g, unknown or other
  misc_feature (672)..(673): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacncgacccccaaactcctcatttatcgtaacaacaatcggccctcgtcgggtccctgaccgattctccgcctccaagtctggccacctcacgcctcgctggccatccacgtgggtcctacccgaggtctaggacggattggacgggttcgtatttaccgtaacgtcgacccgtaggtccggttaggaaacggtcgttacgggtttccgggacgggtaagggtaaacttaacggccgttacggaacccggtttaccgtaacggttccacgggtaccccaaacggggtccttacccgggccccctttacgggttacctaacccgttccgttccgttttacccccccaaccccgtttccgtacccgtaaaccgtacgtttaaaccggttcttaccggttaagggccgggtcccggggtccgtacgggtaacccggaggtacccggtaacctacggtagccggntacgcagngcgngngcngcncgacncgacngngnagngngcnnnnnncnncnncncnnc

SEQ ID NO: 264877 - DNA, 311 bp, Homo sapiens
  misc_feature: GYAE6OF02H3SDR.24.53.E09.1.454.CMB.1.raw
  modified_base (284)..(311): a, c, t, g, unknown or other
  misc_feature (284)..(311): n is a, c, g, or t
tcagactactatgtcacgaccggtgctcgatttagagagagtgtgttgggtttgggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcacgcccaaggctcgccccctcggtcactctcttcccaccctcctcacatagtagtctgaggcggctggacaaggcgcatagnnnnnnnnnnnnnnnnnnnnnnnnnnnn

SEQ ID NO: 264878 - DNA, 423 bp, Homo sapiens
  misc_feature: GYAE6OF02FZ0C7.24.53.E09.1.454.CMB.1.raw
  modified_base (238)..(238): a, c, t, g, unknown or other
  misc_feature (238)..(238): n is a, c, g, or t
  modified_base (390)..(390): a, c, t, g, unknown or other
  misc_feature (390)..(390): n is a, c, g, or t
  modified_base (393)..(423): a, c, t, g, unknown or other
  misc_feature (393)..(423): n is a, c, g, or t
tcagactactatgtcacgaccggtgctcgatttagagagagtgtgttgggtttgggagcaacatcggcgcaggttttgatgtccactggtacaagcagcttccaaaaacagcccccaaactcctcatttatcgtaacaacaatcggccctctggggtccctgaccgattctccgcctccaagtctggcacctcagcctcgctggccatcactgggctccaggctgaggatggagggtnattactactgccagtcgtacgaagatggttcggcggagggactaagcgtgacccgtctaggtcacgccaaggctcgccccctggtcacgtctcgtccccgtccctcctcactatagtacgtctgacgcgggctcggactaaggcgacagtancgnnnnnnnnnnnnnnnnnnnnnnnnnnnnnnn

SEQ ID NO: 264879 - DNA, 292 bp, Homo sapiens
  misc_feature: GYAE6OF02GM21G.24.53.E09.1.454.CMB.1.raw
  modified_base (279)..(292): a, c, t, g, unknown or other
  misc_feature (279)..(292): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgaggtgattactactgccagtcgtacgaagatgttcggcggaggactaagctgaccgtcctaggtcagccaaggctcgccccctggtccactctcgttcccgccctcctcacatagtagtctgagcggctggacaagcgcatagnnnnnnnnnnnnnn

SEQ ID NO: 264880 - DNA, 750 bp, Homo sapiens
  misc_feature: GYAE6OF02IXENH.24.53.E09.1.454.CMB.1.raw
  modified_base (297)..(297): a, c, t, g, unknown or other
  misc_feature (297)..(297): n is a, c, g, or t
tcagactactatgtcacgaccggtgctcgatttagagagagtgtgttggggtttggggagggcttggtccagccctgggggggtccctgagactctcctgtgcagcctctggattcccctttagtgactttttggatgacctgggtccgccaggctccaggggacgggctggagtgggtggccaatataaggcacgatggacgtagcatgtactatgtggactctgtggacggccgattccacctatcctccagacgaccaacgcccaagaacctcactgtatcgagtaatcgaacncgcctgagacgtcggaggacgacggctagtgtattacgtggtcgacgaccatactcagtcctacgtggacgtccgacgtatcgtaagtaacttcttaccgaacgtctacgggttcggggacccgtacggggaccctcccggtcggtacccgttacccgtcccgttaccctccgtacccggtaccctaccccgaaaccggtaacccgggtccccgttaacggttccccggtttcccccgtttacccccggtccgggaccccgttccccccgttccggtccccgtaccggtaccgggtaaccgacccgtaccccggttaccggaaccggtaccgacccgaccgtaccgggacccgggtccccgtacgggtccgtccggtaccggttaccgggtaaccgtacccggtaacctttacccgttaccaacgttacggtacgttaccggtcgtaaccggg

SEQ ID NO: 264881 - DNA, 286 bp, Homo sapiens
  misc_feature: GYAE6OF02FP8QD.24.53.E09.1.454.CMB.1.raw
  modified_base (277)..(286): a, c, t, g, unknown or other
  misc_feature (277)..(286): n is a, c, g, or t
tcagactactatgtcacgaccggtgctcgatttagagagagtgtgttgggtttgggggtgtggtggtctccactcccgccttgacgggctgctatctgcctcgctggccatcactggctccaggctgaggatgagggtgattactactgccagtcgtcgaagatgttcggcggaggactaagctgaccgtcctaggtcagcccaaggctgccccctggtcactctgttccccaccctcctcacatagtagtctgagcgggctggcaaggcgcatagnnnnnnnnnn

SEQ ID NO: 264882 - DNA, 306 bp, Homo sapiens
  misc_feature: GYAE6OF02HSJS9.24.53.E09.1.454.CMB.1.raw
  modified_base (262)..(262): a, c, t, g, unknown or other
  misc_feature (262)..(262): n is a, c, g, or t
  modified_base (284)..(306): a, c, t, g, unknown or other
  misc_feature (284)..(306): n is a, c, g, or t
tcagactactatgtcacgaccggtgctcgatttagagagagtgtgttggggtttggggggtgtggtggtctccactcccgccttgacggggctgctatctgcctcgctggccatcactgggctccaggctgaggatggagggtgattactactgccagtcgtcgaagatgttcggcggagggactaagctgaccgtctaggtcagcccaaggctcgccccctcggtcactctcgttcccaccctcctcacatagtgtctggngcgggctggcaggccacagtannnnnnnnnnnnnnnnnnnnnnn

SEQ ID NO: 264883 - DNA, 712 bp, Homo sapiens
  misc_feature: GYAE6OF02I7QI5.24.53.E09.1.454.CMB.1.raw
  modified_base (166)..(166): a, c, t, g, unknown or other
  misc_feature (166)..(166): n is a, c, g, or t
  modified_base (285)..(285): a, c, t, g, unknown or other
  misc_feature (285)..(285): n is a, c, g, or t
  modified_base (544)..(544): a, c, t, g, unknown or other
  misc_feature (544)..(544): n is a, c, g, or t
  modified_base (648)..(648): a, c, t, g, unknown or other
  misc_feature (648)..(648): n is a, c, g, or t
  modified_base (659)..(659): a, c, t, g, unknown or other
  misc_feature (659)..(659): n is a, c, g, or t
  modified_base (662)..(664): a, c, t, g, unknown or other
  misc_feature (662)..(664): n is a, c, g, or t
  modified_base (681)..(681): a, c, t, g, unknown or other
  misc_feature (681)..(681): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (701)..(701): a, c, t, g, unknown or other
  misc_feature (701)..(701): n is a, c, g, or t
  modified_base (707)..(708): a, c, t, g, unknown or other
  misc_feature (707)..(708): n is a, c, g, or t
  modified_base (710)..(710): a, c, t, g, unknown or other
  misc_feature (710)..(710): n is a, c, g, or t
tcagactactatgtcacgaccggtgctcgatttagagagagtgtgttggggtttgggggctgttttggtaagctgcttgtaccagagggtcaccactctcctgcacgtgggagcaacatcgcggcagttttgatcgtcactggtacaagcacgcttaccaaaaacncgacccccaaactcctcatttacgtactaaacaactaactccggccctcgtcggggtacctcgaccggtacttctcccgcctaccagtcgtcggcctaccgtcacggtccgtccgtacncggtaccgactacgtcgtacggtccgtaccgacggtcgtggaacggtacggaggtaagggtgggttaacctacgtaaccttccgcgtaacggtacggtacgaacgtagtaccgggtttcgggaacggtaggtaaaccgttaaggtccgtacgggtacccccgttctacgggtacacccggtacccgaacggtttcccggccgtcccccggtttcgggtacctacgttacccgttacccgttacccccgttaaacccccnccgttaaaccgccgttaaaggtttaacggttacgtaaccttcgggaaccgggtcgggtccgtacggtacgggtaacggacccgtaacgttagaagtcgagtcgngactcggacangcnnngtcgtcgtcacgcgagngtcgagcgcgacncncnctntcgcanngnac

SEQ ID NO: 264884 - DNA, 299 bp, Homo sapiens
  misc_feature: GYAE6OF02HPW7F.24.53.E09.1.454.CMB.1.raw
  modified_base (286)..(299): a, c, t, g, unknown or other
  misc_feature (286)..(299): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctcggtcactctcgtccccgcctcctcacatagtagtctgagcgggctggctaaggccgtcaagtagnnnnnnnnnnnnnn

SEQ ID NO: 264885 - DNA, 736 bp, Homo sapiens
  misc_feature: GYAE6OF02GC6BV.24.53.E09.1.454.CMB.1.raw
  modified_base (592)..(592): a, c, t, g, unknown or other
  misc_feature (592)..(592): n is a, c, g, or t
tcagactactatgtcacgaccggtgctcgatttagagagagtgtgttgggtttggggaggcttggtccagcctggggggtccctgagacctctcctgtgcagcctctggactttcccctttagtgtacttttggatggcctgggtccgccaggctccgagggcgggctggagtgggtggccaatataaggcacgatggacgtagcatgtactatgtggactctgtgaacgggcctattccaccatccaccaagacaccaaaccgtccccaagtaacctcacgttgtactcttaaggaaatacgaccacgtcctaggagtacgtacggaacggaccgtacggtcttagttagttactttagtgtcgaccgactaatacacagccacgtggacgtcgactagttctaagtaacttaccttacgagtcgttagttccgggggacctacgggtcccacccgtcggtacctacccggtccctcccgacgtcccgtccctaccgaacccgaaccgggtcccctacgggtttccccggttccccttacccccggcggacccccgtcccggttccgtaacccgtcccggtacggaacccnccccggttaacccgtaccccggaagtacccgaccaaccggaccggtcccgggcccggtacgggtccctacgggtcccgtaacggtaccgtaaccgttacccttacgttacccgaactaacggtttacgttaccggcgtaccggg

SEQ ID NO: 264886 - DNA, 647 bp, Homo sapiens
  misc_feature: GYAE6OF02JC2UZ.24.53.E09.1.454.CMB.1.raw
  modified_base (165)..(165): a, c, t, g, unknown or other
  misc_feature (165)..(165): n is a, c, g, or t
  modified_base (253)..(253): a, c, t, g, unknown or other
  misc_feature (253)..(253): n is a, c, g, or t
  modified_base (585)..(585): a, c, t, g, unknown or other
  misc_feature (585)..(585): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (626)..(627): a, c, t, g, unknown or other
  misc_feature (626)..(627): n is a, c, g, or t
  modified_base (629)..(631): a, c, t, g, unknown or other
  misc_feature (629)..(631): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagtcttaccaaaaacncgacccccaaactcctctatttatacgtaaaccaacaatccggccctgtcggggtccctgaccgtacttcctcccgcctcgaacgtcncggcctacctcgacgcctccgcgtacggccatccacgtggcctccgagcgtggaaggatggagggtctacgtttaactcgtaccggcgtaagtccggtaaggaaagtagttcgggttccgggagggcggtaaacgtaagcgtaccgtaccgcgttaaggcaccgtacccgacggtccctcccggtcccccgttacgactaccgttccgttaccccgtcccccgtaccccgtcctaacccggaactaggttaccgtttaacggtaccgtcggaaccggggtccgggacggttaccggaaccgggtaaacggtcccgaccgtaagtaacgcgtntaagcccagccngcncngnnagtncgcncgcacgngngtgnngnnngagncacgngcgncag

SEQ ID NO: 264887 - DNA, 644 bp, Homo sapiens
  misc_feature: GYAE6OF02IOEHL.24.53.E09.1.454.CMB.1.raw
  modified_base (480)..(480): a, c, t, g, unknown or other
  misc_feature (480)..(480): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(615): a, c, t, g, unknown or other
  misc_feature (614)..(615): n is a, c, g, or t
  modified_base (618)..(621): a, c, t, g, unknown or other
  misc_feature (618)..(621): n is a, c, g, or t
  modified_base (623)..(623): a, c, t, g, unknown or other
  misc_feature (623)..(623): n is a, c, g, or t
  modified_base (625)..(631): a, c, t, g, unknown or other
  misc_feature (625)..(631): n is a, c, g, or t
  modified_base (633)..(634): a, c, t, g, unknown or other
  misc_feature (633)..(634): n is a, c, g, or t
  modified_base (636)..(643): a, c, t, g, unknown or other
  misc_feature (636)..(643): n is a, c, g, or t
tcagactactatgtcacgaccggtgctcgatttagagagagtgtgttggggtttgggggctgtttttggaagctgcttgtaccagagggtcaccatctcctgcactggggagcaacatcggcgctagggttttgatgtccactggtacaagctagccttaccaaaaaacacgacccccaaactcctctaattttatacgtaaaccaacaagtccggaccctcgtcggggtccctaggacccgtacttcgtccccgccctaccgaaagttccgtcggaccacctcaggtccctccgcgttccggacacttcaccggttcggggccctaccgagggtacctagggaggtaaggtgggtaagggttaggtaactttaaccgtacctcggccgtaacggttcgggtaacgaaggtagttcggtcgggacgggaagggtactacggctcggtaacccgtacggtacgtacaccggacgacgtccnccccggtcccctaggtcctaccttaccggttcccttaccccacccgttccacctacgttacgtacggtcgtcgtcggacggtcgggtccggtacggacgtaacgggtcgactagtaacgctcnncnatgngncnncannnncncnnnnnnncnncnnnnnnnnc

SEQ ID NO: 264888 - DNA, 317 bp, Homo sapiens
  misc_feature: GYAE6OF02IFFAM.24.53.E09.1.454.CMB.1.raw
  modified_base (166)..(166): a, c, t, g, unknown or other
  misc_feature (166)..(166): n is a, c, g, or t
  modified_base (296)..(317): a, c, t, g, unknown or other
  misc_feature (296)..(317): n is a, c, g, or t
tcagactactatgtcacgaccggtgctcgatttagagagagtgtgttgggtttggggggtgtggtggtctccactcccgccttgacggggctgctatctgcctcgctggccatcactgggctccgagctgaggatgagggtgattactactgccagtcgtcgaagntgtcggcggaggaactaagctcgaccgtctaggtcacgacccaaggctcgccccctcggtcacgtctcgttacccaccctcctcacgtatacgtagtctgaggcggctggccgaaaggcgtacagtacgnnnnnnnnnnnnnnnnnnnnnn

SEQ ID NO: 264889 - DNA, 306 bp, Homo sapiens
  misc_feature: GYAE6OF02JHAOQ.24.53.E09.1.454.CMB.1.raw
  modified_base (285)..(287): a, c, t, g, unknown or other
  misc_feature (285)..(287): n is a, c, g, or t
  modified_base (289)..(291): a, c, t, g, unknown or other
  misc_feature (289)..(291): n is a, c, g, or t
  modified_base (293)..(298): a, c, t, g, unknown or other
  misc_feature (293)..(298): n is a, c, g, or t
  modified_base (300)..(306): a, c, t, g, unknown or other
  misc_feature (300)..(306): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctgccccctggtcactctcgttccccaccctcctcactatagtacgtctgacgcgggctggcaaggcgacatgnnntnnngnnnnnntnnnnnnn

SEQ ID NO: 264890 - DNA, 624 bp, Homo sapiens
  misc_feature: GYAE6OF02H8E3C.24.53.E09.1.454.CMB.1.raw
  modified_base (235)..(235): a, c, t, g, unknown or other
  misc_feature (235)..(235): n is a, c, g, or t
  modified_base (588)..(590): a, c, t, g, unknown or other
  misc_feature (588)..(590): n is a, c, g, or t
  modified_base (592)..(599): a, c, t, g, unknown or other
  misc_feature (592)..(599): n is a, c, g, or t
  modified_base (601)..(624): a, c, t, g, unknown or other
  misc_feature (601)..(624): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagccttaccaaaaacacgaccccccaaactcctactatttaactcgtaaacaacaatccggccctcgtggggtccctgacgtatccnccgcctccaagtctcggccacctcacgcctcgctcggaccactcgaccgtcgggtccgtccacggctaggaggagtgggaggggtagtaacttaacgtacgtcgtaccgtacgtacggtacggtaaagtacgttgggttaccgggcggggaacggggtaacgtaaggaccgttacggtaacccgtaccggtacgggttaccaacggaccccgtaaacgggtccctcccggtcccccgtccggtacctaaccgttcgttacccttccccgtaccccttcccgtacctaactacgttacgtacgttacgtacgggtacggtcgggcgtcggacgaacggcggactacgagtacgnnngnnnnnnnngnnnnnnnnnnnnnnnnnnnnnnnn

SEQ ID NO: 264891 - DNA, 581 bp, Homo sapiens
  misc_feature: GYAE6OF02FOSC4.24.53.E09.1.454.CMB.1.raw
  modified_base (376)..(376): a, c, t, g, unknown or other
  misc_feature (376)..(376): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (538)..(540): a, c, t, g, unknown or other
  misc_feature (538)..(540): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (550)..(551): a, c, t, g, unknown or other
  misc_feature (550)..(551): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (565)..(566): a, c, t, g, unknown or other
  misc_feature (565)..(566): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccacgtggtacaagcagcttccaaaaaacagcccccaaaactcctcattttatccgtaaacaacaatccggaccctcgtcggggtacccctggaccgtattccgccgcctaccaagttctcggctacctgacgcctcgctcggaccatccacgtgggcctaccacggctgacgggagtacgaggggtgattaccgtactgcccaggtcgttacgaagctggttcggacggagggactagacncgtaccgtcgtacgtcacgacccgaagcctccgtccccgtagtcccggaaccttccgtcggttaccccgtcccctacctaccaaccgagttacgtacggtcttacggcgtacgggcgtaggtaccgaacggcgactacgtaacgnacgcngntcngatgcannngnagngcgcnncgtacgnacancannagacactnanacntc

SEQ ID NO: 264892 - DNA, 376 bp, Homo sapiens
  misc_feature: GYAE6OF02H7XX5.24.53.E09.1.454.CMB.1.raw
  modified_base (285)..(286): a, c, t, g, unknown or other
  misc_feature (285)..(286): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (294)..(295): a, c, t, g, unknown or other
  misc_feature (294)..(295): n is a, c, g, or t
  modified_base (299)..(299): a, c, t, g, unknown or other
  misc_feature (299)..(299): n is a, c, g, or t
  modified_base (301)..(305): a, c, t, g, unknown or other
  misc_feature (301)..(305): n is a, c, g, or t
  modified_base (307)..(376): a, c, t, g, unknown or other
  misc_feature (307)..(376): n is a, c, g, or t
tcagactactatgtcacgaccggtgctcgatttagagagagtgtgttgggtttgggggggtgtggtggtctccactcccgccttgacggggctgctatctgcctcgctggccaatcactgggctccgaggctgaggatgagggtgattactactgccagtcgtcgaagatgttcggcggagggactaagctgaccgtcctaggtcagcccaaggctcgcccctggcactctcgttccccaccttctcacatagtatctggacgcgggctgggacaggcacatagnnctntancnnctangnnnnnannnnnnnnnnnnnnnnnnnnnnnnnnnnnnnnnnnnnnnnnnnnnnnnnnnnnnnnnnnnnnnnnnnnnn

SEQ ID NO: 264893 - DNA, 658 bp, Homo sapiens
  misc_feature: GYAE6OF02H2OMA.24.53.E09.1.454.CMB.1.raw
  modified_base (182)..(182): a, c, t, g, unknown or other
  misc_feature (182)..(182): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
tcagactactatgtcacgaccggtgctcgatttagagagagtgtggttgggtttggggggtgtggtggtctccacgtcccgcctttagaccggggcgtgcctaagtccttgcctcgtcgtggccatcacctgggctccaggctgaggatgacggtgattactacgtgccagtcgtcggtaangtgttcggcggtaggactagcctgtaccgtctaggtcacgaccgaaggtctcgcccctacgggtactacgttcctaccgttccccgaacccgtcctacgaaactnttacgtacgtcgtacgacggtcggtaccgtggacgaaggtcctacgtagttagtcngttancggatgacgttggaccngtacgctacggacgcgtacncgtacggagtcgactactactaacngacgtcggaanacaatagngacttanacgtagcggtaacgtcgtaactcgtacgtaccgttanacgtagaacctaagtacctaacgaattaccgacgttacgttagtaagttaccgtaacacgtacacggtactaaccgtgaccgtaagtacgacgtaacgtacgacgtaagtacgtaagttacttagaacgtaagtacgtacgtacgtacttagtagttacgaacggtacggtacgtacgtagtacg

SEQ ID NO: 264894 - DNA, 785 bp, Homo sapiens
  misc_feature: GYAE6OF02JM9IL.24.53.E09.1.454.CMB.1.raw
tcagactactatgtcacgaccggtgctcgatttagagagagtgtgttgggtttgggaggcttggtccagcctggggggtccctgagactctcctgtgcagcctctggacttcccctttagtgtacttttggatgacctgggtccgccaggctccgagggacgggctggagtggggtcgaccaatataaggtccacgtagtcggacgtagcagtgtactatggtaggactcgtggtaggaacggccaattccaccatcctaccagagaccaacgacccagaaccttccacttagtagtacgtaggtaaaagttcgaacctaggacccttggacggtaaggtccggaacggacgacgggacttagtacgttagttaccgtggttacggacccgtaccaagttacttcgtaacgccctaacgtcgggaccgtacgtactagtaccgtagtaacgttaccttacgacgtacgtaggttcgggtccgacgggtaccgtacccgttaccgggtaccgtacccgtaccgttccctaccggaccctcctaccccgaaccggaaccggacccgtacggttcccggttacccgttcccccggtccggtacccggtcccggccgttacccgtacccggtaacgaccgtcccgtaacccgttcccggacgacccggtacaacggttaccgggaccccggttccggtccgggtaccgtccggtcccggtcggttaacggtaacccgggtaaccttaccggttacccgtactaacgttacggtacgttaggtacccggg

SEQ ID NO: 264895 - DNA, 281 bp, Homo sapiens
  misc_feature: GYAE6OF02HMR3C.24.53.E09.1.454.CMB.1.raw
  modified_base (278)..(281): a, c, t, g, unknown or other
  misc_feature (278)..(281): n is a, c, g, or t
tcagactactatgtcacgaccggtgctcgatttagagagagtgtgttgggtttgggggtgtggtggtctccactcccgccttgacgggctgctatctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcatagnnnn

SEQ ID NO: 264896 - DNA, 730 bp, Homo sapiens
  misc_feature: GYAE6OF02IHVKV.24.53.E09.1.454.CMB.1.raw
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
tcagactactatgtcacgaccggtgctcgatttagagagagtgtgttgggtttgggggtgtggtggtctccactcccgccttgacgggctgctatctgcctcgctggcccatcactgggtctccgaggcgtgaggatggagggtgacttactactgccagtccgtcggaagtagtcgttccgggcgggtacgggtacttaagccgtcggaccgtcgtacgggtcacggcccgtaaggccgtaccgtcccccggtcggtactccgtccgttccggttcccccaccccgttccttaccaacccgtaagttacggtaacgttccgtggtacgggccggggtaccgttaggaccgaaccgggccgtaccaattaggcttccgagccctgaccgtgaacgnggtaaccttggnttaaccgtcgggtcaaaggtttaggtctacctaaccccagggggtccncgttaaacgtgtaccggacgttactaccgtaacggacttaacgtacgtcgtaacgcggtttacaccgttcgtaacgttctacgtacgtacgtacgtaccgtacgtacgtacgtcgtacgtacggtacgtacgttacgtacgtacgtcgtactacgtacgtcgtacgtacgtactacgtacgtacgtacgtacgtacgtacgttacgtaccgtacgtacgtacgtcgtacgtacgtacgtgtacgtacgttactaacgtacgtagtacgtagtcg

SEQ ID NO: 264897 - DNA, 295 bp, Homo sapiens
  misc_feature: GYAE6OF02GETXU.24.53.E09.1.454.CMB.1.raw
  modified_base (233)..(233): a, c, t, g, unknown or other
  misc_feature (233)..(233): n is a, c, g, or t
  modified_base (281)..(295): a, c, t, g, unknown or other
  misc_feature (281)..(295): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatggagggtgattactactgccagtcgtcgaagatgttcggcggaggactaagctgaccgtcctaggtcagccagctcgcccctgtcactctcgtccccnccctcctcactatagtagtctgaggcggctggacaagggcacagtagnnnnnnnnnnnnnnn

SEQ ID NO: 264898 - DNA, 537 bp, Homo sapiens
  misc_feature: GYAE6OF02H3EZJ.24.53.E09.1.454.CMB.1.raw
  modified_base (164)..(164): a, c, t, g, unknown or other
  misc_feature (164)..(164): n is a, c, g, or t
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (456)..(456): a, c, t, g, unknown or other
  misc_feature (456)..(456): n is a, c, g, or t
  modified_base (504)..(505): a, c, t, g, unknown or other
  misc_feature (504)..(505): n is a, c, g, or t
  modified_base (507)..(537): a, c, t, g, unknown or other
  misc_feature (507)..(537): n is a, c, g, or t
tcagactactatgtcacgaccggtgctcgatttagagagagtgtgttgagtttgggggctgtttttggaagctgcttgtaccagagggtcaccatctcctgcactggggagcaacatcggcgcaggttttgatgtccactggtacaagcagcttaccaaaaacncgcccccaaatcctctatttanacgtaacaaacatccggccctgtcgggtaccctgaccgtattccnccgcctaccaagtcctcggccacctcgacgcctcgccgtggccatcacgtgggcctccgaggctggagntggagggtntacttacgctcgaccgtgtccggtagaagtntcggtcgggagggaggactaagctacggaccgtcgtaaggtcaccggtaccaaggtcctaccgtcccccgtggacctactccgttcctacccccgcctccgtaccatagttacgtnttcgtaggaccgggtcggaccgtagggaccgaaggccacgtaagtcgnngnnnnnnnnnnnnnnnnnnnnnnnnnnnnnnn

SEQ ID NO: 264899 - DNA, 492 bp, Homo sapiens
  misc_feature: GYAE6OF02GBYC6.24.53.E09.1.454.CMB.1.raw
  modified_base (165)..(165): a, c, t, g, unknown or other
  misc_feature (165)..(165): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (462)..(492): a, c, t, g, unknown or other
  misc_feature (462)..(492): n is a, c, g, or t
tcagactactatgtcacgaccggtgctcgatttagagagagtgtgttggggtttgggggctgtttttggaagctgcttgtaccagagggtcaccatctcctgcactgggagcaacatcggcgcaggttttgatgtccactaggtacaagcagcttccaaaaaacngaccccccaaaactcctcatttatccgtaaacaacaaatcggccctctggggtccctgaccgtattctccgcctaccaagtcncggcacctcacgcctcgctggccatcactgggactccaggctggaggangagggtgattactactgccgagtcgtgaagagtgtacggcggagggactaagcgtggacctcctagcacgccgaagctcgcccctgacactctcgtccccacctcctactaacntaacgtagtcgtgacggacggtctacggaccgaacggcgtanacgtacgcnnnnnnnnnnnnnnnnnnnnnnnnnnnnnnn

SEQ ID NO: 264900 - DNA, 663 bp, Homo sapiens
  misc_feature: GYAE6OF02G8UUW.24.53.E09.1.454.CMB.1.raw
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (595)..(595): a, c, t, g, unknown or other
  misc_feature (595)..(595): n is a, c, g, or t
  modified_base (623)..(623): a, c, t, g, unknown or other
  misc_feature (623)..(623): n is a, c, g, or t
  modified_base (628)..(629): a, c, t, g, unknown or other
  misc_feature (628)..(629): n is a, c, g, or t
  modified_base (631)..(631): a, c, t, g, unknown or other
  misc_feature (631)..(631): n is a, c, g, or t
  modified_base (633)..(635): a, c, t, g, unknown or other
  misc_feature (633)..(635): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (655)..(656): a, c, t, g, unknown or other
  misc_feature (655)..(656): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
tcagactactatgtcacgaccggtgctcgatttagagagagtgtggttgggtttgggggctgtttttggaagctgcttgtaccagagggtcaccatctcctgcactgggagcaacatcggcgcgtaggttttgatgtccacgtggtacaaggctagccttaaccaaaaacncgacccccaaatcctactatttancgtaacaactagtccggcctcgtcgggtccctagacgtnttccnccgccgtcaagtcgtggaccacctcgacgtcctcgcgtcggacctcgtactacggtgggaccctccggaggtcgtaggaggagtcggacggggtatacgttaccgttcgtacgccgtaaggttcgtacggaagttacggttcggtcgggacgggaacggtaactcggtactccggtaaccgttcgaacggtccgaacccggtccgaacgtcccgtacccgtccccgttggaccctacgtttcccgtacccgtacccctcccctacgtcgtaacgttaccgtacgtcgttaccggtacgggtcggggtcggtaccggtaaacgggccgtaaaacgggcccgttaagacgtacgcgtnacggtcaaggtccagttgaagtttcganccgtnngngnnncgcgngnncgngtgngctcnngcncnnc

SEQ ID NO: 264901 - DNA, 546 bp, Homo sapiens
  misc_feature: GYAE6OF02HDYI9.24.53.E09.1.454.CMB.1.raw
  modified_base (165)..(165): a, c, t, g, unknown or other
  misc_feature (165)..(165): n is a, c, g, or t
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (439)..(439): a, c, t, g, unknown or other
  misc_feature (439)..(439): n is a, c, g, or t
  modified_base (498)..(498): a, c, t, g, unknown or other
  misc_feature (498)..(498): n is a, c, g, or t
  modified_base (518)..(539): a, c, t, g, unknown or other
  misc_feature (518)..(539): n is a, c, g, or t
  modified_base (541)..(546): a, c, t, g, unknown or other
  misc_feature (541)..(546): n is a, c, g, or t
tcagactactatgtcacgaccggtgctcgatttagagagagtgtgttgggtttgggggctgtttttggaagctgcttgtaccagagggtcacccatctcctgcactgggagcaacatcggcgcaggttttgatgtccactggtacaagcagccttaccaaaaacngccccccaaatcctcatttactcgtaaacaacaatccggccctcgttcggggtccctagaccgtattccncccgcctccaagtcctggccacctcacgcctcgctggcccatcactgggcctccgaggctaggaggatcggagggtnattacctacgtnacctagtccgtagaaagntcggttcggacggtaaggacctaaggctacggtacccgtcgtaagcaccgacccaaggtcctccgacccccgtgtaccacttcgtcccgttaccccncccttccctacactagttacgtacgttctaggacggtcgggctcgggacgacgggccanacgttagctgactgcatgannnnnnnnnnnnnnnnnnnnnncnnnnnn

SEQ ID NO: 264902 - DNA, 799 bp, Homo sapiens
  misc_feature: GYAE6OF02FZT6T.24.53.E09.1.454.CMB.1.raw
  modified_base (362)..(362): a, c, t, g, unknown or other
  misc_feature (362)..(362): n is a, c, g, or t
tcagactactatgtcacgaccggtgctcgatttagagagagtgtgttgggtttggggaggcttggtccagcctggggggtccctgagactctcctgtgcagcctctggacttcccctttagtgactttttggatgacctgggtccgccaggctccagggacggggctggagtgggtggaccaagtataaggcagatggacgtagcatgtactatgtggactctgtaggaagggtccgattcactatctaccagacgacaacgccagaactcactgtactcgtaggaaactcgaccacgtccgtgacggagtcggaacgacgtacggtactactagtttactacgtggtacgcgaactatacncgacgtaccgtaccgtggtacgtccgctattacctaggtaaccttaccgttacaagtacgttaagggttcccgggggacctaacggggtcccctaaaccggtttcggtaccccgtaaccccggttccttaccccggttacctacccggtaccccgttaacccggaaaccccggtaaccggtaccccgttaccggttcccgggtttacccccgttccccgggttacccggtccccgttccccggtcccgtacccgttacccggtaacgggtacccgtaccccgaacccggttacccggaccgtaccggtacccaaccgggtacccgtacccgggtccccgtagggtcccggttccggtaccggttacgggtaacccgtaaccggttaccttaccgttaccgtaccgttaaccgtaacggttaccgtacggtaaccggg

SEQ ID NO: 264903 - DNA, 482 bp, Homo sapiens
  misc_feature: GYAE6OF02F00Y6.24.53.E09.1.454.CMB.1.raw
  modified_base (162)..(162): a, c, t, g, unknown or other
  misc_feature (162)..(162): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (450)..(452): a, c, t, g, unknown or other
  misc_feature (450)..(452): n is a, c, g, or t
  modified_base (454)..(482): a, c, t, g, unknown or other
  misc_feature (454)..(482): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccactggtacaagcagcttaccaaaaacngccccccaaactccctcatttatcgtaacaacaatccggccctctggggtccctgacccgattctccgcctccaagtctggcacctcagcctcgctggccatcacgtgggctccaggctcgaggatgagggtgattactactgccagtcgtcgaagatgtcggcggagggactaagctgacccgttctaggtcacgcccgaaggcctcgcccccgtcggtccgtactcctcgttccccaccctccgtcacatagtgtctgagcgggcnggcgaacggcncgtatgntnnnannnnnnnnnnnnnnnnnnnnnnnnnnnnn

SEQ ID NO: 264904 - DNA, 530 bp, Homo sapiens
  misc_feature: GYAE6OF02GLP0D.24.53.E09.1.454.CMB.1.raw
  modified_base (110)..(110): a, c, t, g, unknown or other
  misc_feature (110)..(110): n is a, c, g, or t
  modified_base (170)..(170): a, c, t, g, unknown or other
  misc_feature (170)..(170): n is a, c, g, or t
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (490)..(490): a, c, t, g, unknown or other
  misc_feature (490)..(490): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagactactatgtcacgaccggtgctcgatttagagagagtgtgttgggtttgggagcaacatcggcgcaggttttgatgtccactggtacaagcagcttccaaaaacngcccccaaatcctcatttatcgtaacaacaatcggccctctggggtccctgaccgattcnccgcctccaagtctggcacctcagcctgctggcctatcacgtgggctaccaggctggaggatgacgggtnacttactactgccaagtcgtacgaagatggttacggcggtaggactaagcctagacccgtctaggtcagcccgaaaggccncgtccccctggtacacgtctcgtacccgccctcctcgaccagttagagtctggacgccgggactggaccaagggcacaactagctagngcngactganacgatcagntccagtacncgatcgananagancacagacgtacgacacgacgactacacgagacgagacgngagtacgacgacagtagacacanactacgcagnacgagac

SEQ ID NO: 264905 - DNA, 742 bp, Homo sapiens
  misc_feature: GYAE6OF02G71UV.24.53.E09.1.454.CMB.1.raw
  modified_base (241)..(241): a, c, t, g, unknown or other
  misc_feature (241)..(241): n is a, c, g, or t
  modified_base (340)..(340): a, c, t, g, unknown or other
  misc_feature (340)..(340): n is a, c, g, or t
tcagactactatgtcacgaccggtgctcgatttagagagagtgtgttgggtttggggaggcttggtccagcctggggggtccctgagactctcctgtgcagcctctggattcccctttagtgactttttggatgacctgggtccgccaggccccagggacgggctggagtgggtggccaatataaggcacgatggacgtagcatgtactatgtggactctgtgaagggccattcaccatcncagagacaacgcccagaactcactgtatctggaaatcgaccagcctagacgagtcggaggtacacggctagttgtacttactggtgaccgaccattacncgagccaaccgtggacgtcgctattcgtacgaacttacttacccgagcgttaaggttccgggggaccggaggggacccctaccccgtcgggttacccgacccggttcccttaccccgtccgtaccggttcccctaacccgtacccgaaacccggggtacccctaccggttcccggtttccccgtttcccccccggtacgggtccccgtccccgttccggccccttaccggaacgggtccgacccgtaccccgtaacccggacgaccgccgaccgaccggtaccccgggtcccggtcgggtccggtccggtcccggttacgggttaccgaaaccgggttaccctttaacccttacccgtaaccgttaacgttaaccggttcgttaccggtacgggtaccgggg

SEQ ID NO: 264906 - DNA, 621 bp, Homo sapiens
  misc_feature: GYAE6OF02HPZSR.24.53.E09.1.454.CMB.1.raw
  modified_base (164)..(164): a, c, t, g, unknown or other
  misc_feature (164)..(164): n is a, c, g, or t
  modified_base (239)..(239): a, c, t, g, unknown or other
  misc_feature (239)..(239): n is a, c, g, or t
  modified_base (584)..(584): a, c, t, g, unknown or other
  misc_feature (584)..(584): n is a, c, g, or t
  modified_base (588)..(589): a, c, t, g, unknown or other
  misc_feature (588)..(589): n is a, c, g, or t
  modified_base (591)..(593): a, c, t, g, unknown or other
  misc_feature (591)..(593): n is a, c, g, or t
  modified_base (596)..(599): a, c, t, g, unknown or other
  misc_feature (596)..(599): n is a, c, g, or t
  modified_base (602)..(602): a, c, t, g, unknown or other
  misc_feature (602)..(602): n is a, c, g, or t
  modified_base (604)..(606): a, c, t, g, unknown or other
  misc_feature (604)..(606): n is a, c, g, or t
  modified_base (608)..(609): a, c, t, g, unknown or other
  misc_feature (608)..(609): n is a, c, g, or t
  modified_base (611)..(621): a, c, t, g, unknown or other
  misc_feature (611)..(621): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaaacncgccccccaaaactccttaccattttatcgtaaaccaacaaattccggccctctcggggtccctgaccgatttcncccgcctaccaagtctggccacctcacgccctcgctcggccatccacgtcgggcctccgaggccttaggaggtactggagggtcgattactactggacctagttcggtacggaaagtacgttcggttcggggacggacgggtaacgtaaagtcgtcggtaaccccgttaccgtaggaccgtaacgccccgaaacggtccctccgacccccccgtttcgggtcctaacccttcttaccgtttccccccaccccgttcccttacaacgttaactacggttaccgtacctacgggacggcggtccggtaggtaccgaagggtccgcctaaacttagggcagtcaagtncgtnngnnncgnnnngancnnngnncnnnnnnnnnnn

SEQ ID NO: 264907 - DNA, 365 bp, Homo sapiens
  misc_feature: GYAE6OF02F1YNP.24.53.E09.1.454.CMB.1.raw
  modified_base (244)..(244): a, c, t, g, unknown or other
  misc_feature (244)..(244): n is a, c, g, or t
  modified_base (284)..(285): a, c, t, g, unknown or other
  misc_feature (284)..(285): n is a, c, g, or t
  modified_base (287)..(288): a, c, t, g, unknown or other
  misc_feature (287)..(288): n is a, c, g, or t
  modified_base (290)..(291): a, c, t, g, unknown or other
  misc_feature (290)..(291): n is a, c, g, or t
  modified_base (293)..(294): a, c, t, g, unknown or other
  misc_feature (293)..(294): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(365): a, c, t, g, unknown or other
  misc_feature (303)..(365): n is a, c, g, or t
tcagactactatgtcacgaccggtgctcgatttagagagagtgtgttggggtttggggggtgtggtggtctccactcccgccttgacggggctgctatctgcctcgctggccatcactgggctccaggctgaggatgagggtgattactactgccagtcgtcgaagatgttcggcggagggactaagctgaccgtctaggtcagccaaggctgccccctggtcactctgttccccaccctcctnacatagtagtctgaggcgggctggacaagggcactatagnngnnanncnnagcgnanannnnnnnnnnnnnnnnnnnnnnnnnnnnnnnnnnnnnnnnnnnnnnnnnnnnnnnnnnnnnnn

SEQ ID NO: 264908 - DNA, 665 bp, Homo sapiens
  misc_feature: GYAE6OF02IF2XI.24.53.E09.1.454.CMB.1.raw
  modified_base (165)..(165): a, c, t, g, unknown or other
  misc_feature (165)..(165): n is a, c, g, or t
  modified_base (631)..(632): a, c, t, g, unknown or other
  misc_feature (631)..(632): n is a, c, g, or t
  modified_base (635)..(638): a, c, t, g, unknown or other
  misc_feature (635)..(638): n is a, c, g, or t
  modified_base (640)..(640): a, c, t, g, unknown or other
  misc_feature (640)..(640): n is a, c, g, or t
  modified_base (642)..(646): a, c, t, g, unknown or other
  misc_feature (642)..(646): n is a, c, g, or t
  modified_base (648)..(651): a, c, t, g, unknown or other
  misc_feature (648)..(651): n is a, c, g, or t
  modified_base (653)..(654): a, c, t, g, unknown or other
  misc_feature (653)..(654): n is a, c, g, or t
  modified_base (656)..(657): a, c, t, g, unknown or other
  misc_feature (656)..(657): n is a, c, g, or t
  modified_base (660)..(660): a, c, t, g, unknown or other
  misc_feature (660)..(660): n is a, c, g, or t
  modified_base (662)..(665): a, c, t, g, unknown or other
  misc_feature (662)..(665): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgctaggttttgatgtccactggtacaaagcagcttaccaaaaacncgacccccaaactcctactattttaatacgtaaacaaacaacgtccggaccctcgtcggggtccctaggacccgtattccgccgtaccctaccgaaacttcgtacggaccctacctacacgtcccgtcgcttacggacctacttaccgaccgttgggacctcccgaagggtcttaggggaagtactagggtacgggttataattttacccgaacgttcggactacggttacggtacgaaaggtattcgggttcggggacgaaggggtaacaacgtcggtaccgtaaccgtcggtacgtaccacggacccctaaggccctacccggtccccttcggtactaccgtcctttccccgaacccctaacccctttcaccgtaacgtacgttacggttaccgttacgtacgggaacgggtaccggcgttaaggaccggaactccggaacaaggttagcagacgtcagtgcannacnnnnancnnnnncnnnncnnanngancnnnn

SEQ ID NO: 264909 - DNA, 703 bp, Homo sapiens
  misc_feature: GYAE6OF02IKERV.24.53.E09.1.454.CMB.1.raw
  modified_base (166)..(166): a, c, t, g, unknown or other
  misc_feature (166)..(166): n is a, c, g, or t
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (667)..(667): a, c, t, g, unknown or other
  misc_feature (667)..(667): n is a, c, g, or t
  modified_base (675)..(675): a, c, t, g, unknown or other
  misc_feature (675)..(675): n is a, c, g, or t
  modified_base (685)..(685): a, c, t, g, unknown or other
  misc_feature (685)..(685): n is a, c, g, or t
  modified_base (694)..(694): a, c, t, g, unknown or other
  misc_feature (694)..(694): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
tcagactactatgtcacgaccggtgctcgatttagagagagtgtgttgggtttgggggctgtttttggaagctgcttgtaccagagggtcaccatctcctgcactgggagcaaacatcggcgcaggttttgatgtccactggtacaagcagccttaccaaaaaacncgacccccaaaactcctctattttaacncgtaaacaacaactccggccctcgtcggggtccctgaccgattcnccgcctcaagtctgcacctcagcctcgctcggaccatcactgggctccaggcctgacggtatggacggtagaacttacgtactacgcccgagtcggtacgaaggtacgttcggttaccgggacggggaagggtaacctaaaggtccgtaagtaacccccgttccgttaaccgggtaccgaacggtaaccccggaaaggtccggtacccggtaccccccgtttcccgggtactaaaccccggtttcggtacccgtttccccccgggaccccttaccccgttaaccgaaccttaaacgtttaacggtaacgtttacgtacggtaccgggtaccgggggtccgttacggggaaccggaacgggtacccgtaacgaaacgttagtataccgacacgacncngtancatanagtactanacacananacgagngtagctanacgtacacgngtacgctantacganagn

SEQ ID NO: 264910 - DNA, 326 bp, Homo sapiens
  misc_feature: GYAE6OF02IQ1P1.24.53.E09.1.454.CMB.1.raw
  modified_base (292)..(293): a, c, t, g, unknown or other
  misc_feature (292)..(293): n is a, c, g, or t
  modified_base (295)..(326): a, c, t, g, unknown or other
  misc_feature (295)..(326): n is a, c, g, or t
tcagactactatgtcacgaccggtgctcgatttagagagagtgtgttgggtttggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctctcacatagtagtctagaggcggggctagggcaaagggccgctagtagnntnnnnnnnnnnnnnnnnnnnnnnnnnnnnnnnn

SEQ ID NO: 264911 - DNA, 789 bp, Homo sapiens
  misc_feature: GYAE6OF02FGLHF.24.53.E09.1.454.CMB.1.raw
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
tcagactactatgtcacgaccggtgctcgatttagagagagtgtgttgggtttgggaggcttggtccagcctggggggtccctgagactctcctgtgcagcctctggacttccctttagtgtactttttggatgacctgggtccgccaggctccgagggacgggctggagtgggtcgccaatagtaaggcacgatggacgtagcatgtactatgcggactgtgtgaacgggcctattcacctactcctaccaggtacgaacgaaccgtcccgagaacctcaaccttgtacttntagggaaaatcgaacccaggtaccttaggaacggacgttacggacgggaactaccgggtactacgttagttacttacgnggttcggaccgaactatacaccgtaacgctaaccggtaggtacgtccgtatacgtccgtaacgtaaactttcccgttaacgaggtacgttacggggttccggggaccggttaacgggacccctaaccggtttcggtaccctacccgtcgttacccctcgacccgtccccgttaacccgaacccggtaaccggacccttaccgttcccggttaccccgtttcccccggtaccgggcccgttccccgtttcggaccgttacccgaacgggcctaaccccggtccgtaccggtagtacccgaaccgccggaaccgggttccgtacccgggtcggtaccgttccggtaccggtcccggtaaacggtaacggttacccttaacggttccaaggttacgttaacggtacgttcgtaaccgggg

SEQ ID NO: 264912 - DNA, 586 bp, Homo sapiens
  misc_feature: GYAE6OF02G5DB6.24.53.E09.1.454.CMB.1.raw
  modified_base (111)..(111): a, c, t, g, unknown or other
  misc_feature (111)..(111): n is a, c, g, or t
  modified_base (164)..(164): a, c, t, g, unknown or other
  misc_feature (164)..(164): n is a, c, g, or t
  modified_base (550)..(550): a, c, t, g, unknown or other
  misc_feature (550)..(550): n is a, c, g, or t
  modified_base (553)..(586): a, c, t, g, unknown or other
  misc_feature (553)..(586): n is a, c, g, or t
tcagactactatgtcacgaccggtgctcgatttagagagagtgtgttggggtttgggggctgtttttggaagctgcttgtaccagagggtcaccatctcctgcactgggancaacatcggcgcaggttttgatgtccactggtacaagcagcttaccaaaaacncgaccccctaaactcctctattttactacgtaaacaaactaagtccggtcccttcgtcgggtccctgaccgtattccgtcccgtcctaccgaagttccgtcggacctacctcacgtcccgtcgaccgtcggaccagttccacgtgggtcctaccgaggtccgttggacggtgtcggaggtagtacttactcgtcgacgtacgttccgacgaagtcgttggttcggcggaaggtactacggcgtcgtaccgtccgtaggccacgcccgagccgtcccgcccggtcgtcctaccttcgtccccgttaccccgcccgttccctacgtaacgtacgttacggtccgtttacggacggtacggcgggtcgtcgtacggagcgacaggtctncgnnnnnnnnnnnnnnnnnnnnnnnnnnnnnnnnnn

SEQ ID NO: 264913 - DNA, 543 bp, Homo sapiens
  misc_feature: GYAE6OF02G4D76.24.53.E09.1.454.CMB.1.raw
  modified_base (163)..(163): a, c, t, g, unknown or other
  misc_feature (163)..(163): n is a, c, g, or t
  modified_base (305)..(305): a, c, t, g, unknown or other
  misc_feature (305)..(305): n is a, c, g, or t
  modified_base (515)..(543): a, c, t, g, unknown or other
  misc_feature (515)..(543): n is a, c, g, or t
tcagactactatgtcacgaccggtgctcgatttagagagagtgtgttgggtttgggggctgtttttggaagctgcttgtaccagagggtcaccatctcctgcactgggagcaacatcggcgcaggttttgatgtccactggtacaagcagcttaccaaaaacngccccccaaactccctcatttatcgtaacaacaatccggccctcgtggggtcccctgacccgattcctccgcctccaagtcctggccacctcagccctcgctcggccatcacgtgggcctccgaggctggaggatggaggtnattactacgtgcccgagtccgtcgaagtagtggttccgggcgggacgggtactaaggctcggtaccgtccgtaggccacgacccgaaggccgtaccgccccccgtcggtcctaccttccgtccgttccccccaaccccttcctaccacctaagttacgttacgtccgtggacggccgggcgtcggacgaacgggcgacgtatacgctagnnnnnnnnnnnnnnnnnnnnnnnnnnnnn

SEQ ID NO: 264914 - DNA, 823 bp, Homo sapiens
  misc_feature: GYAE6OF02HH5UQ.24.53.E09.1.454.CMB.1.raw
  modified_base (160)..(160): a, c, t, g, unknown or other
  misc_feature (160)..(160): n is a, c, g, or t
  modified_base (715)..(715): a, c, t, g, unknown or other
  misc_feature (715)..(715): n is a, c, g, or t
tcagactactatgtcacgaccggtgctcgatttagagagagtgtgttgggttggggctgttttggaagctgcttgtaccagagggtcaccatctcctgcactgggagcaacagtcggcgctaggtttgattgccatggtacaagcagacttaccaaaaanccgtacccccaaatcctctaagtttatacgtaaaaccaacgtaacgttccggacccttcggtcggggtaccccttaggaccggtaactttccgcccgtccttaccgaaaggtttcctagggcctaaccttcgactcccgtcgtaaccctggtaccaacttaccgacgttcggggttccctaaaccgggacggtccgtacgggaaacggtggtacgggtaggggtacttaacgttaacctaacgttcggaccgtaggttacccggtaaggtaaaaggtcgttcggttacggacggggaaacggtaccgttaaggcgtttaaccggaccccgttacggttaaacggccgtaaccgacccggtaacgtcccggttaacccgtcccccgggtttaacggacccttcgttaccccgtttacccggttcccccctaacccttacccggaaccgttaacttaccggttaaacgttcggtttaacctaacggggtacggcggggttacctaacggggaacttaacgggggccccttaacggtaaaggtccgtcgtaacgtcgngcgcgcgtacgtacgacgtacgtcgtacgacgtcgtacgtacgcgtgtacgtacgtcgtacgtactacgtagtacgtacgtacgtacgtacgtacgacgtacgtgacg

SEQ ID NO: 264915 - DNA, 689 bp, Homo sapiens
  misc_feature: GYAE6OF02GTE23.24.53.E09.1.454.CMB.1.raw
  modified_base (165)..(165): a, c, t, g, unknown or other
  misc_feature (165)..(165): n is a, c, g, or t
  modified_base (616)..(616): a, c, t, g, unknown or other
  misc_feature (616)..(616): n is a, c, g, or t
  modified_base (635)..(635): a, c, t, g, unknown or other
  misc_feature (635)..(635): n is a, c, g, or t
  modified_base (649)..(649): a, c, t, g, unknown or other
  misc_feature (649)..(649): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (687)..(687): a, c, t, g, unknown or other
  misc_feature (687)..(687): n is a, c, g, or t
tcagactactatgtcacgaccggtgctcgatttagagagagtgtgttggggtttgggggctgtttttggaagctgcttgtaccagagggtcaccatctcctgcaactgggagcaacatcggcgcaggttttgatgtccactggtacaagcagcttaccaaaaacncgacccccaaaatccctcaatttataccgtaaacaaccaatccggccctgtcggggtccctgaccgtattcctcccgcctacaagtctcggccacctcacgcctcgtctcggccatccacgtcgggacctccgaggtcctaggacgtagtcgggacggggtagtaactttaccgtacgtcgaccgtaggttccgtaacggaaggtacgttcggtcgggacggacgggtaactaacgcgtacggaccgtacgttacggtaccacggtacccgaaggtccctccggtacccccgtcgttacctacgttccgtttcccggttacccccgtcccttcccgtaacccgtacgttaaacgtttacggttacgttcggtacgggtccggggtccgggtaccggttaacgggacccggttaaccggggccgtaccggtaaaccgttggacttcgaggtntacgctcggctagcgaagngcgtctcgtacgcngcgtcactcgctcacgcgcgctcgngcgcnctacgtcncg

SEQ ID NO: 264916 - DNA, 331 bp, Homo sapiens
  misc_feature: GYAE6OF02G5LFD.24.53.E09.1.454.CMB.1.raw
  modified_base (290)..(291): a, c, t, g, unknown or other
  misc_feature (290)..(291): n is a, c, g, or t
  modified_base (293)..(294): a, c, t, g, unknown or other
  misc_feature (293)..(294): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (302)..(331): a, c, t, g, unknown or other
  misc_feature (302)..(331): n is a, c, g, or t
tcagactactatgtcacgaccggtgctcgatttagagagagtgtgttgggttgggggtgtggtggtctcactcccgccttgacgggctgctatctgcctcgctggccatcactgggctccaggctgaggatgagggtgattactactgccagtcgtcgaagatgttcggcggaggactaaggctgacccgtctaggtcacgcccaaggctcgccccctggtcactcctgttccccgccctcctcacatagtacgtctggacgtcgggattcggacaacggcgactagagnnannancatnannnnnnnnnnnnnnnnnnnnnnnnnnnnnn

SEQ ID NO: 264917 - DNA, 600 bp, Homo sapiens
  misc_feature: GYAE6OF02HKUBM.24.53.E09.1.454.CMB.1.raw
  modified_base (241)..(241): a, c, t, g, unknown or other
  misc_feature (241)..(241): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (524)..(524): a, c, t, g, unknown or other
  misc_feature (524)..(524): n is a, c, g, or t
tcagactactatgtcacgaccggtgctcgatttagagagagtgtgttgggtttgggaggcttggtccagcctggggggtccctgagactctcctgtgcagcctctggacttcccctttagtgtactttttggatgacctgggtccgccaggctccgagggcggggctggagtgggtggccaatataaggcacgatggacgtagcatgtactatgtgactctgtgaacgggccgattcaccntctcagacacaaccgccagactcatgtatcgtaggaaactcgaaccagcctagagacgcgacggacacggtctatgttattcgtgtcaccactatacncgacgccacgtggacgtcnctatcgtanaaccttctcgagcgtaggtcgggacctacggccctaccgtgtccgtacctctccncgtccncctaccgaccgaacggaccctcgttcccggttcccgtccccgtcgccccgcccgtgtcccgccggaacggcctcccgaacccgtcgaacgcgaccncggaccgcccggccgcggtccgacggtccgtacggaccgaaccgtccttaccgtacagtacttacggtcgcgtcgg

SEQ ID NO: 264918 - DNA, 736 bp, Homo sapiens
  misc_feature: GYAE6OF02HO7G1.24.53.E09.1.454.CMB.1.raw
  modified_base (161)..(161): a, c, t, g, unknown or other
  misc_feature (161)..(161): n is a, c, g, or t
  modified_base (655)..(655): a, c, t, g, unknown or other
  misc_feature (655)..(655): n is a, c, g, or t
  modified_base (665)..(665): a, c, t, g, unknown or other
  misc_feature (665)..(665): n is a, c, g, or t
  modified_base (675)..(675): a, c, t, g, unknown or other
  misc_feature (675)..(675): n is a, c, g, or t
  modified_base (691)..(691): a, c, t, g, unknown or other
  misc_feature (691)..(691): n is a, c, g, or t
  modified_base (697)..(697): a, c, t, g, unknown or other
  misc_feature (697)..(697): n is a, c, g, or t
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
  modified_base (731)..(731): a, c, t, g, unknown or other
  misc_feature (731)..(731): n is a, c, g, or t
tcagactactatgtcacgaccggtgctcgatttagagagagtgtgttgggtttggggctgttttggaagctgcttgtaccagagggtcaccatctcctgcactgggagcaacatcggcgcaggttttgatgtccactggtacaagcagcttaccaaaaacncgcccccaaatcctccatttactcgtaaacaactaatccggccctcgtcggggtacccctggacccgtattcctacccgccttaccgaaagtccgttcgggccctacctccgaacgtcccctcgtccgtcggacctactccgtaccgtggggacccttccggacggccttaggaaggtagtcggaaggggttcgtaactttacctacgtcgacccgtacggtccggtaccggtaaggtagttccgggttcgggtacgggaacgggtaacctaacggcctaccggtacccgttacggtacggtaccaccggtaccccaaaggggtccctaacccggtccccccgttacggttcccgtaaccgttccgttacccgtttcccccccgtacccgttccccgtaaccgtaacgtaggtttaaaccgtcgtttaccggtaggtaccgggtccgggtccggtagggtaacccggtacgggaccgtaacgtaacgtacggtnacgtctacgntagaccttgnagtccagcgcaagtcncgactnctcacgcgtcgtcncgcngtacgtcgtcgcgacnctatc

SEQ ID NO: 264919 - DNA, 359 bp, Homo sapiens
  misc_feature: GYAE6OF02HBCRM.24.53.E09.1.454.CMB.1.raw
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (299)..(359): a, c, t, g, unknown or other
  misc_feature (299)..(359): n is a, c, g, or t
tcagactactatgtcacgaccggtgctcgatttagagagagtgtgttggggtttgggggggtgtggtggtctccactcccgccttgacggggctgctatctgcctcgctggccatcactgggctccaggctgaggatgagggtgattactactgccagtcgtcgaagatgttcggcggagggactaagctgaccgtcctaggtcagcccaaggctcgccccctggtcactctcgttccccaccctcctcacatagtactctggagcggacgtggacgaaggcgtacatacgngncatcnnnnnnnnnnnnnnnnnnnnnnnnnnnnnnnnnnnnnnnnnnnnnnnnnnnnnnnnnnnnn

SEQ ID NO: 264920 - DNA, 300 bp, Homo sapiens
  misc_feature: GYAE6OF02IB5RZ.24.53.E09.1.454.CMB.1.raw
  modified_base (293)..(300): a, c, t, g, unknown or other
  misc_feature (293)..(300): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatgagggtgattactactgccagtcgtcgaagatgttcggcggaggactaagctgaccgtcctaggtcacgacccgaaggctcgccccctcggtcactctcgttccccgccctcctcactatacgtactcgtggacggcggcgtggacgaaggcgcatagnnnnnnnn

SEQ ID NO: 264921 - DNA, 286 bp, Homo sapiens
  misc_feature: GYAE6OF02F8CKR.24.53.E09.1.454.CMB.1.raw
  modified_base (282)..(286): a, c, t, g, unknown or other
  misc_feature (282)..(286): n is a, c, g, or t
tcagactactatgtcacgaccggtgctcgatttagagagagtgtgttgggtttgggggtgtggtggtctccactcccgccttgacggggctgctatctgcctcgctggccaccactgggctccaggctgaggatgagggtgattactactgccagtcgtcgaagatgttcggcggagggactaagctgaccgtcctaggtcagcccaaggctcgccccctcggtcactctcgttcccaccctcctcacatagtagtctgagcgggctggcaaggcgcatagnnnnn

SEQ ID NO: 264922 - DNA, 396 bp, Homo sapiens
  misc_feature: GYAE6OF02J2DHI.24.53.E09.1.454.CMB.1.raw
  modified_base (340)..(396): a, c, t, g, unknown or other
  misc_feature (340)..(396): n is a, c, g, or t
tcagactactatgtcacgaccggtgctcgatttagagagagtgtgttgagtttgggtgtgtggtggtctccactcccgccttgacggggctgctatctgcctcgctcggccatcacgtcgggctccaggctgaggatgagggtgaattacctactgacccaggtcgtacgaagtagtcggttccggggacggaggggactaacgcgtcgtacccgtccgtaggccacgaccccgtaacgggccttccgccccccgttacggtcctacgttccttcccgttccccgccccttccacaccatacggtatcgtgcgccgggactggccaagggccatagagcnnnnnnnnnnnnnnnnnnnnnnnnnnnnnnnnnnnnnnnnnnnnnnnnnnnnnnnnn

SEQ ID NO: 264923 - DNA, 442 bp, Homo sapiens
  misc_feature: GYAE6OF02H6TZL.24.53.E09.1.454.CMB.1.raw
  modified_base (94)..(94): a, c, t, g, unknown or other
  misc_feature (94)..(94): n is a, c, g, or t
  modified_base (142)..(142): a, c, t, g, unknown or other
  misc_feature (142)..(142): n is a, c, g, or t
  modified_base (334)..(334): a, c, t, g, unknown or other
  misc_feature (334)..(334): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (380)..(381): a, c, t, g, unknown or other
  misc_feature (380)..(381): n is a, c, g, or t
  modified_base (384)..(442): a, c, t, g, unknown or other
  misc_feature (384)..(442): n is a, c, g, or t
tcagactactatgtcacgaccggtgctcgatttagagagagtgtggttggggtttgggggggtgtggtggtctccactcccgccttgacggggntgctatctgcctcgctggccatcacgtgggcctccagggctggaaggntagggaaggggttgtaaatttacctacgtcggcccaggttccggtaagaaaggtagtttcgggttccggggaggggaacgggtaactaacggcctcggtaacccgtcgtaagccaccggaccggtaagcccgtccgtaccccctcggtacacgttccgtcccgttaccccaccctctcaagttagtacggtntcgtagggacggcggttacgcggaggacggtnactaagtgntgntnnagnnnnnnnnnnnnnnnnnnnnnnnnnnnnnnnnnnnnnnnnnnnnnnnnnnnnnnnnnnn

SEQ ID NO: 264924 - DNA, 294 bp, Homo sapiens
  misc_feature: GYAE6OF02JE6DN.24.53.E09.1.454.CMB.1.raw
  modified_base (282)..(294): a, c, t, g, unknown or other
  misc_feature (282)..(294): n is a, c, g, or t
tcagactactatgtcacgaccggtgctcgatttagagagagtgtgttgggtttggggggtggtggtggtctccactcccgccttgacggggctgctatctgcctcgctggccatcactgggctccaggctgaggatgagggtgattactactgccagtcgtcgaagatggttcggcggagggactaagctgaccgtctaggtcagcccaagcctcgccccctcggtccactctcgttccccgccctctcacatagtagtctgagcggctggcaggcgcatannnnnnnnnnnnn

SEQ ID NO: 264925 - DNA, 326 bp, Homo sapiens
  misc_feature: GYAE6OF02JTA3W.24.53.E09.1.454.CMB.1.raw
  modified_base (303)..(326): a, c, t, g, unknown or other
  misc_feature (303)..(326): n is a, c, g, or t
tcagactactatgtcacgaccggtgctcgatttagagagagtgtgttgggtttgggggtgtggtggtctccactcccgccttgacggggctgctatctgcctcgctggccatcactgggctccaggctgaggatggagggtgattactactgccagtcgtcgaagatgttcggcggagggactaagctgaccgtcctaggtcagccctaaggctcgccccctggtcacttcgtcgttcctccacccctcctcaacattagtacgtctggacggcgggtcctggacctaagggccacgtatagnnnnnnnnnnnnnnnnnnnnnnnn

SEQ ID NO: 264926 - DNA, 704 bp, Homo sapiens
  misc_feature: GYAE6OF02IU1WF.24.53.E09.1.454.CMB.1.raw
  modified_base (110)..(110): a, c, t, g, unknown or other
  misc_feature (110)..(110): n is a, c, g, or t
  modified_base (122)..(122): a, c, t, g, unknown or other
  misc_feature (122)..(122): n is a, c, g, or t
  modified_base (164)..(164): a, c, t, g, unknown or other
  misc_feature (164)..(164): n is a, c, g, or t
  modified_base (648)..(648): a, c, t, g, unknown or other
  misc_feature (648)..(648): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (670)..(672): a, c, t, g, unknown or other
  misc_feature (670)..(672): n is a, c, g, or t
  modified_base (675)..(675): a, c, t, g, unknown or other
  misc_feature (675)..(675): n is a, c, g, or t
  modified_base (679)..(680): a, c, t, g, unknown or other
  misc_feature (679)..(680): n is a, c, g, or t
  modified_base (682)..(683): a, c, t, g, unknown or other
  misc_feature (682)..(683): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (691)..(692): a, c, t, g, unknown or other
  misc_feature (691)..(692): n is a, c, g, or t
  modified_base (694)..(694): a, c, t, g, unknown or other
  misc_feature (694)..(694): n is a, c, g, or t
  modified_base (697)..(698): a, c, t, g, unknown or other
  misc_feature (697)..(698): n is a, c, g, or t
  modified_base (701)..(702): a, c, t, g, unknown or other
  misc_feature (701)..(702): n is a, c, g, or t
  modified_base (704)..(704): a, c, t, g, unknown or other
  misc_feature (704)..(704): n is a, c, g, or t
tcagactactatgtcacgaccggtgctcgatttagagagagtgtgttgggtttgggggctgtttttggaagctgcttgtaccagagggtcaccatctcctgcactgggancaacatcggcgntaggttttgatgtccatggtacaagcagcttaccaaaaaacncgaccccccaaaactcctactaattttactacgtaaacaaaccaatcccggccctcggttcggggtccctagaccgtattccgtccgcctccaagtcgtcggctacctcaggtcctcgctcggacctatcacgtcgggcctaccgaggcgtggtaaggtacgtaggtagggtcttaaattaccgtaacgtcggacccttaacggtcggtaaacgaaggttaacgttcggtaccggggacggtaacggggtaacttaaggcccggttaacggtaccccggttacgtaacggggtcaacccggtaccgaaacgggtccgttacccggtccccccggtttacgggtaccttaaccgttccccgttaaccccgtttccccccaccccgtttaacccctaacgtaaaccgtaagtttaccgtttacggtacggtttacggcgggttaccgggcgttacgggacggtaaccgggactacggaataccggnactacgntngngtgngtngngnnncanactnnanncancnctnncncgnncgnntn

SEQ ID NO: 264927 - DNA, 526 bp, Homo sapiens
  misc_feature: GYAE6OF02FZXK6.24.53.E09.1.454.CMB.1.raw
  modified_base (162)..(162): a, c, t, g, unknown or other
  misc_feature (162)..(162): n is a, c, g, or t
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (496)..(526): a, c, t, g, unknown or other
  misc_feature (496)..(526): n is a, c, g, or t
tcagactactatgtcacgaccggtgctcgatttagagagagtgtgttgggtttgggggctgtttttggaagctgcttgtaccagagggtcaccatctcctgcactgggagcaacatcggctcaggttttgatgtccactggtacaagcagcttccaaaaacngccccccaaaactccctcatttatcgtaaacaacaatcggccctcgtggggtccctgaccgattcctccgcctaccaagtctggctaccctnacgcctcgctggcccatcactgggcctccaggctggaggatggaggtgattacactgcaggtcgtagaagntcggtcggnggaggactagctaggaccgtctaggtcacgacccgaagtcctaccgccccgtcggtcaccgtcgttcgtccccctacccgtcctaccactagttacgtacgtctaggacggcggggtcacgggtaccgaacgggtccgacgtacttaaggctanacgtnacnnnnnnnnnnnnnnnnnnnnnnnnnnnnnnn

SEQ ID NO: 264928 - DNA, 689 bp, Homo sapiens
  misc_feature: GYAE6OF02FIO05.24.53.E09.1.454.CMB.1.raw
  modified_base (163)..(163): a, c, t, g, unknown or other
  misc_feature (163)..(163): n is a, c, g, or t
  modified_base (191)..(191): a, c, t, g, unknown or other
  misc_feature (191)..(191): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (674)..(675): a, c, t, g, unknown or other
  misc_feature (674)..(675): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(682): a, c, t, g, unknown or other
  misc_feature (681)..(682): n is a, c, g, or t
  modified_base (684)..(685): a, c, t, g, unknown or other
  misc_feature (684)..(685): n is a, c, g, or t
  modified_base (687)..(689): a, c, t, g, unknown or other
  misc_feature (687)..(689): n is a, c, g, or t
tcagactactatgtcacgaccggtgctcgatttagagagagtgtgttgggtttggggctgttttggaagctgcttgtaccagagggtcaccatctcctgcactgggagcaacatcggcgctaggttttgatgtccactggtacaagcagtcttaccaaaaacncgacccccaaactcctactaattttacnccgtaaacaacaacgtccggacccttcgtcggggttcccctagaaccgtatttccctcccgacccgtacctaaacggttccgtacgggaccttaaccccgttcaacgtccccgtcggaccttcggacccctagttccgaaccgttcggggccttaccgacggtcttaggaagggtatggaaggggtctaacgtttactaacgtcgtacccaggttcgaccggaaatcgttcggttaccgggcgggtaagggtactaaggcgtacgaccccggttagtacgggtcacggccctaaaggccgtccgcccccggttacggtacctacgttaccgttcccgtacccctaaccccgttcctaaccgaccgtaagtaccgttaacggtccgttacggacgggtacccgggtacggtaccggaccgtaaggccgtccaaagttggacctggatcgctagcncgtagctngngnangcngangnngncncnncncncnncnncnnn

SEQ ID NO: 264929 - DNA, 695 bp, Homo sapiens
  misc_feature: GYAE6OF02IZAZ3.24.53.E09.1.454.CMB.1.raw
  modified_base (191)..(191): a, c, t, g, unknown or other
  misc_feature (191)..(191): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
tcagactactatgtcacgaccggtgctcgatttagagagagtgtgttgagtttgggggctgtttttggaagctgcttgtaccagagggtcaccatctcctgcactgggagcaacatcggcgcaggttttgatgtccactggtacaagcagcttacaaaacagcccccaaatcctcatttatcgtaaacaanaatcgcctcgtgggtaccctgaccgattcctccgcctaccaagtctacgcctacctcacgcctcgctaggccatcacgtggcctccgagctgaggactgagggtnactactactcgaccgagttcggtacgaagtacgtggttaccgggngggaacgggtaacgttaacggctacggaacccgttccgttaagggtcccaagtaccccgaagggcccttaccggaccccccgttcggtaccaacccgtttccctttacccggttaccccctaaccccctttcccgaaccgtaaacccgttaacgtttaaacggtttaaccgtaccgggttacggtaccgggtaccggggtaccgttaccggggaacgtaaccgggacggttccgaaaacggtttacgctaaccgcgtaaccggagtcgtacgtacgtacgagtagagcgtacgtacactactacagacgtacgtactacgtacgtagtacgtagatcgtagtcgacgagacgac

SEQ ID NO: 264930 - DNA, 611 bp, Homo sapiens
  misc_feature: GYAE6OF02JA5OR.24.53.E09.1.454.CMB.1.raw
  modified_base (147)..(147): a, c, t, g, unknown or other
  misc_feature (147)..(147): n is a, c, g, or t
  modified_base (162)..(162): a, c, t, g, unknown or other
  misc_feature (162)..(162): n is a, c, g, or t
  modified_base (353)..(353): a, c, t, g, unknown or other
  misc_feature (353)..(353): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (552)..(552): a, c, t, g, unknown or other
  misc_feature (552)..(552): n is a, c, g, or t
  modified_base (561)..(564): a, c, t, g, unknown or other
  misc_feature (561)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (578)..(579): a, c, t, g, unknown or other
  misc_feature (578)..(579): n is a, c, g, or t
  modified_base (581)..(582): a, c, t, g, unknown or other
  misc_feature (581)..(582): n is a, c, g, or t
  modified_base (584)..(585): a, c, t, g, unknown or other
  misc_feature (584)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
tcagactactatgtcacgaccggtgctcgatttagagagagtgtgttgggtttgggggctgttttggagctgcttgtaccagagggtcaccatctcctgcactgggagcaacagtcggcgcaggtttttgatgtccactggtacaancagcttaccaaaacncgccccaaactcctgtatttactcgtaaccaacaactccggccctcgtacgggtccctagacgaattcgtccgcctacaagtccgtacgccaccctcgacgccctacggcctcggacctaactccgaacgttcgggccttacccgaggtcctaggtaacggaggtacggtcggtagtaactttacgtaacncgcgtacgtcgtcgaagttagtcggttacggcggaggtactaacggtcgacgtaccgcgtacggtaccgacggaccacgggccttaccgtccccggttgtactaccgttcctacggttaccccncccgttacncgtactaacgtacgtacgtacgttcgacgggtccggagtaccggaagtaccgggcacgttgaacgntacgcacgnnnncncncncnctntcnncnntnncnncncgnngngncncnctcncncnc

SEQ ID NO: 264931 - DNA, 768 bp, Homo sapiens
  misc_feature: GYAE6OF02FSURC.24.53.E09.1.454.CMB.1.raw
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
  modified_base (671)..(671): a, c, t, g, unknown or other
  misc_feature (671)..(671): n is a, c, g, or t
  modified_base (691)..(691): a, c, t, g, unknown or other
  misc_feature (691)..(691): n is a, c, g, or t
  modified_base (703)..(703): a, c, t, g, unknown or other
  misc_feature (703)..(703): n is a, c, g, or t
  modified_base (721)..(721): a, c, t, g, unknown or other
  misc_feature (721)..(721): n is a, c, g, or t
tcagactactatgtcacgaccggtgctcgatttagagagagtgtgttgagtttgggggctgttttggaagctgcttgtaccagagggtcaccatctcctgcactgggagcaacatcggcgcaggttttgatgtccactggtacaagcagcttaccaaaaacngacccccaaactcctcatttatcgtaacaacaatcggccctcgtcggggtccctgaccgattccnccgcctccaagtctggcctacctcacgcctcgactcggcctatcgacgttcgggcctccgaggtctacggaggtatggaaggggtntaacgtttacctaaccgtggccctaggttaccggtaccgtaaaggtacgttacgggtttccggggacgggtaacgggtaacttaaacggccttaacgggtaaccccgttccggttaaggggtacccgtaaccgggtacccccgaaacggggttcccgttaaccccgggtcccccccggtttaccgggtaccctaaaccggtttcccgtttacccggtttacccccccaaaccccgtttccctaaccgtaacctagtttaaaccggtacgggttccctaagggggtacccggaccgggggttcctacggggggtaacctaaaccggggcccggtacttaaaggttccggattcgacgtncggcttaacgccagttaccncgtcgtcgtacncgtcgtacgtcgtcgacncgtcgatacgacgtacgacgtacgtcgtacgtcgtcgtactcgtacg

SEQ ID NO: 264932 - DNA, 602 bp, Homo sapiens
  misc_feature: GYAE6OF02H9D3M.24.53.E09.1.454.CMB.1.raw
  modified_base (226)..(226): a, c, t, g, unknown or other
  misc_feature (226)..(226): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (601)..(601): a, c, t, g, unknown or other
  misc_feature (601)..(601): n is a, c, g, or t
tcagactactatgtcacgaccggtgctcgatttagagagagtgtgttgggtttgggggctgttttggaagctgcttgtaccagagggtcaccatctcctgcactgggagcaacatcggcgcaggttttgatgtccatggtacaagcagcttaccaaaaacagacccccaaatcctacatttatcgtaaacaacaactcggccctcgtgggtccctgaccgattccnccgcctaccaatctcggcctacctcgacgcctcgcgtcggaccactacgaccgtgggcctaccgaggtctaggaggtactggaggtgtattacgtactcgacccgtagtcggtacgaagtagttcggtacgggacggaaggtactagcgtcgaccgtcgtaggtcacgccgaagtccgtacgccccgtaggtacaccttcgtccgttacccgcccttaccgtcaacgtacgtagtacgttcgtacggtacggcgggtacctgggccgtaaacggccgaacgaacgtacgtacgagtnacgtanacgtcacganacncngacgctnacgacgacgtanacgagngcacgacgtnagatactacncganactacganc

SEQ ID NO: 264933 - DNA, 405 bp, Homo sapiens
  misc_feature: GYAE6OF02FTTCO.24.53.E09.1.454.CMB.1.raw
  modified_base (171)..(171): a, c, t, g, unknown or other
  misc_feature (171)..(171): n is a, c, g, or t
  modified_base (181)..(181): a, c, t, g, unknown or other
  misc_feature (181)..(181): n is a, c, g, or t
  modified_base (252)..(252): a, c, t, g, unknown or other
  misc_feature (252)..(252): n is a, c, g, or t
  modified_base (321)..(323): a, c, t, g, unknown or other
  misc_feature (321)..(323): n is a, c, g, or t
  modified_base (328)..(328): a, c, t, g, unknown or other
  misc_feature (328)..(328): n is a, c, g, or t
  modified_base (330)..(331): a, c, t, g, unknown or other
  misc_feature (330)..(331): n is a, c, g, or t
  modified_base (333)..(343): a, c, t, g, unknown or other
  misc_feature (333)..(343): n is a, c, g, or t
  modified_base (345)..(405): a, c, t, g, unknown or other
  misc_feature (345)..(405): n is a, c, g, or t
tcagactactatgtcacgaccggtgctcgatttagagagagtgtgttgggtttgggggggtgtggtggtctccactcccgccttgacggggctgctatctgcctcgctggccatcacgtgggctccaggctgaggatggagggtagatttactactggccagtcgtcgaantggttcgggnggaggactaagctcgaccgtcgtagtcacgcccaaggctccgcccccgtggtccacttcctcgttcccccnccccttacctacactagtaggtacgtcgtggacggccgggtgtcggaaccgaacgggtccaagttagcnnncagtnanncnnnnnnnnnnncnnnnnnnnnnnnnnnnnnnnnnnnnnnnnnnnnnnnnnnnnnnnnnnnnnnnnnnnnnnnn

SEQ ID NO: 264934 - DNA, 548 bp, Homo sapiens
  misc_feature: GYAE6OF02HBY93.24.53.E09.1.454.CMB.1.raw
  modified_base (164)..(164): a, c, t, g, unknown or other
  misc_feature (164)..(164): n is a, c, g, or t
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(520): a, c, t, g, unknown or other
  misc_feature (519)..(520): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(528): a, c, t, g, unknown or other
  misc_feature (527)..(528): n is a, c, g, or t
  modified_base (530)..(548): a, c, t, g, unknown or other
  misc_feature (530)..(548): n is a, c, g, or t
tcagactactatgtcacgaccggtgctcgatttagagagagtgtgttgggtttgggggctgtttttggagctgcttgtaccagagggtcaccatctcctgcactgggagcaaacatcggcgcaggtttttgatgtccactggtacaagcagcttaccaaaaacngaccccccaaaactcctnatttatcgtaacaacaatcggccctcgtcggggtccctgaccgtnttcctccgcctccaagtctggcacctcacgcctcgctggccatcactgggcctcgaggctggagatggagggtnacttactacgtcgaccgagtcgtacgaatacgtggttccgggacgggaggacgtaagcttcggacccgttcgaaggtccagtaccccgaaggcctccggcccctcggtaccacttccgtcgttacccccaccctcctaaccacgtaacgttacgtccgtggtacggccggggtctacggcgaaccggtcggacgtaatcgagntgatgatncncnncnnganancnngnnnnnnnnnnnnnnnnnnn

SEQ ID NO: 264935 - DNA, 491 bp, Homo sapiens
  misc_feature: GYAE6OF01EX7T0.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtgggtggcagttatatggtatgatggaagtagtcaaatactatgcagactcgtgaaggccgattcacgtctccagagacaatcccaaagacacgctgtatctgcaaatgaccagcctgagagccgaggacacggctatgtattactgtgcgagagagacagccacg

SEQ ID NO: 264936 - DNA, 515 bp, Homo sapiens
  misc_feature: GYAE6OF01A66N0.34.26.C04.1.454.CMB.1.raw
  modified_base (277)..(277): a, c, t, g, unknown or other
  misc_feature (277)..(277): n is a, c, g, or t
  modified_base (507)..(507): a, c, t, g, unknown or other
  misc_feature (507)..(507): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggtggtttcgcgtaggcgtctttaagtaggtgtcagtgtcaggtgcagctggtggagtcgtgggggagcgtggcccagcctgggacgtccctgagactctcctgtgcagcgtctggattcacctttnagtagtcatggcatgcacgtgggtccgccaggctccaggcaaggggctggagtgggtgcagttatagtggtatgatggaagtagtcaatactatgcagactccgtgaaggccgattccaccgtctccaagacgactaactcccaagaacacgctgtatctgacaaatcgaccaggcctagagacgccgaggacacggactagtgtattacgtgtagacgagaacgagacngtcccacg

SEQ ID NO: 264937 - DNA, 173 bp, Homo sapiens
  misc_feature: GYAE6OF01CZQ89.34.26.C04.1.454.CMB.1.raw
  modified_base (170)..(173): a, c, t, g, unknown or other
  misc_feature (170)..(173): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgggctggcaaggcgcatagnnnn

SEQ ID NO: 264938 - DNA, 507 bp, Homo sapiens
  misc_feature: GYAE6OF01DKHFO.34.26.C04.1.454.CMB.1.raw
  modified_base (301)..(301): a, c, t, g, unknown or other
  misc_feature (301)..(301): n is a, c, g, or t
  modified_base (497)..(497): a, c, t, g, unknown or other
  misc_feature (497)..(497): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccncaggctccaggcaaggggctgggagtgggtgcagttatatggtatgatggaagtagtcaatactatgcagactccgtagaaggccgattcaccgtctaccagagacaatacccaaagaccacgctagtatctagacaaatcgaaccagcctgacgagaccgaggacacggctagtgtattacgtgtgacgagaganacagccaacg

SEQ ID NO: 264939 - DNA, 728 bp, Homo sapiens
  misc_feature: GYAE6OF01BIB1M.34.26.C04.1.454.CMB.1.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (587)..(587): a, c, t, g, unknown or other
  misc_feature (587)..(587): n is a, c, g, or t
tcagtacacgtgatcacgaccggtgctcgatttagtctagcgactttgggtttggggctgggacggaggagcccagtcactagaggtcggtcggtgggtttccgatttcggtgatccagggccactgaacactagaggactcaccatggaggttttgggctgtagcggtggtttcgcgtaggctctttaagaggtggtccgagtggtcaggtggactagggctgggtaggtaggtctgggggaggtcttaggcccaggtccgtaggggacctacctgtacgacctactccttggtgacgcgcgttctcggatttccacccttnagtacgtactanaggacatcgctacgtcgggtccgaccaaggtctaccgaggccgaaggggctagggacggttaggggacgaccgtacgttaacgtagtttgggtagttaggaagttaggtaaacgttacgacctaaagtaccgttaggtacggaacgtaacggtaacccgttaccggtacggtaaaccgggtccgttaactttccgaacccggttccgttaccgggaacgacggtaacccaacgttccccaaacggtaacccncccgtactacgtacctaccgtaccgaaccgtaactccgtacccgtaccgtcccgtacgaccgtaccgaccgtacggaccgtaccggtcgtacgttagtacggtacgtacgtacgacggacgacgacgacgtcgtcggtacg

SEQ ID NO: 264940 - DNA, 664 bp, Homo sapiens
  misc_feature: GYAE6OF01DW5AX.34.26.C04.1.454.CMB.1.raw
  modified_base (285)..(285): a, c, t, g, unknown or other
  misc_feature (285)..(285): n is a, c, g, or t
tcagtacacgtgatcacgaccggtgctcgatttagtctagcgactttgggtttgggctgggaagaggagcccagcacctagaggtcggcggtgtttccattcggttgatcagcactgaacacagaggactcaccatggagtttgggctgtagctggttttcctcgttagtctcttttaagtaggtgtccagtgtcaggtgcagcgtgggtggaggtctgggggagcgtggccccaggcctgggacgtccctgagacctctcctgtgcagcgtctggattcacttnagtatcatggcagtgcacgtgggtccgcgagggctccgaggcaaggggctagggagtgggtgctaggttatagtggtatggtaagtggaaagtagtcaaattacgtaagtggactaagtaccgtaccggtaggaacgggtccgtaatttaccgtaacccgttcctacccgtaaggtaacgtaaccgtaaactaccccgtaaaagaaaccgtaccggtaccttacgttaacttcgtaagaaccctaaaacgttaccggaaccctaaggtccccttaaggacggtaccggacccggaaggacccgtaacggaccgttaacgttacgtaacgttacgtacggttgaccggtagtaacggtaggaactacggtcccgtaacgg

SEQ ID NO: 264941 - DNA, 495 bp, Homo sapiens
  misc_feature: GYAE6OF01BQGAU.34.26.C04.1.454.CMB.1.raw
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggctccaggcaagggctggagtgggtgcagttatagtggtatgatggaatgtcaaatctatgcagactcgtgaaggcgatcacgtctccagagacaatcccaaagaacacgctgtactctgacaaatgaacccagcctgagacgccgaggacacggctatgtattctgtgacgtagagagacagcccacg

SEQ ID NO: 264942 - DNA, 543 bp, Homo sapiens
  misc_feature: GYAE6OF01CLZ1N.34.26.C04.1.454.CMB.1.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (535)..(535): a, c, t, g, unknown or other
  misc_feature (535)..(535): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccaggcctggggacctccctgagactctcctgtgcagcgtctggattcaccttcagtagtcatggcatgcacgtgggtcccnccgaggcctccgaggcaaggggctggagtgggtggcagttanagtggtatgatggaaagtgtacaatactatgacagactccgtaggaacgggccgtattcgaccgtctacgaagacgacaactacccaaagaacacgctgtactcgtagacaaatcgaccagcctaggacgacgccggaaggaccgacgggtctaagttgttaacttcgtgtcgacggagagagacngccctacg

SEQ ID NO: 264943 - DNA, 533 bp, Homo sapiens
  misc_feature: GYAE6OF01BQQPV.34.26.C04.1.454.CMB.1.raw
  modified_base (528)..(528): a, c, t, g, unknown or other
  misc_feature (528)..(528): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggcccagcctgggacgtccctgagactctcctgtgcagcgtctggattcaccttcagtagtcatggcatgcacgtgggtcccgccaggcctccgagggcgaagggggctgggaggtggggtgcagttatagtgggtatgagtggaagtagtacaaatactagtgcagactacgtgaacgggccgtattccgaccgtctaccgaagacgaacaactacccaagaaccacgctagtatcgtgacaaatcgaaccagcctagacgacgcgaggaccacggctagtagtattctgtgacgagagagacngcacg

SEQ ID NO: 264944 - DNA, 501 bp, Homo sapiens
  misc_feature: GYAE6OF01BMAD6.34.26.C04.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggcctccgaggcaaggggctgggagtgggtgcagttanagtggtatgatggaagtgtcaatctangcagactcgtgaggccattcaccgtctcagacacaactacccaagacacgctgtatctagacaaactgacccagcctagacgacgccgaggacacggtctagtgtattctgtgacgagagagacagccacg

SEQ ID NO: 264945 - DNA, 505 bp, Homo sapiens
  misc_feature: GYAE6OF01C86RT.34.26.C04.1.454.CMB.1.raw
  modified_base (302)..(302): a, c, t, g, unknown or other
  misc_feature (302)..(302): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcactgggtccncaggctccaggcaaggggctgggagtggggtgcagttatagtggtatgatggaatgtcaatactatgcagctcgtgaggccatcacgtcncagnacaatcccaagacacgctgtatctgacaaatgaccagcctgacgacgaccgaggaccacggctagtagttattacgtgttgacggtagaacggagaaccagccctaacg

SEQ ID NO: 264946 - DNA, 517 bp, Homo sapiens
  misc_feature: GYAE6OF01D30IY.34.26.C04.1.454.CMB.1.raw
  modified_base (346)..(346): a, c, t, g, unknown or other
  misc_feature (346)..(346): n is a, c, g, or t
  modified_base (510)..(510): a, c, t, g, unknown or other
  misc_feature (510)..(510): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtccgccaggctccgaggcaaggggctgggagtgggtgcagttanagtggtatgatggaagtagtacaatactatgcaagactccggtagaacgggccattcaccgtctccagacgacaactacccaagaacacgctagtactctagacaaatcgaccagcctagacgagaccgaggacacggctatgtattctgtgacgagagagacngcctacg

SEQ ID NO: 264947 - DNA, 493 bp, Homo sapiens
  misc_feature: GYAE6OF01AVFIE.34.26.C04.1.454.CMB.1.raw
  modified_base (487)..(487): a, c, t, g, unknown or other
  misc_feature (487)..(487): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtgggtggcagttatatggtatgatggaagtagtcaatactatgcagactccgtgaaggccgattcaccgtctccagagacaatcccaagaacacgctgtatctgacaaatgaccagcctgagagccgaggacacggctatgtattctgtgcgagagagacngccacg

SEQ ID NO: 264948 - DNA, 530 bp, Homo sapiens
  misc_feature: GYAE6OF01B7J55.34.26.C04.1.454.CMB.1.raw
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagaggtgtccagtgtcaggtgcagctgggtggagtcgtggggggagcgtggcccaggccgtgggacgtccctgagactctcctgtgcagcgtctggattcacttcagtagtcatggcatcgcacgtgggtcccnccaggcctccgaggccgaagggctgggagtgggtgctagttatagtggtatgagtggaagtagtacaaatactatgacagactcgtagaacgggcctatcgaccgtctaccgagtacgacaactcccaaagaacacgctagtactctgacaatcgaccagcctagacgacgccgaagaccgacggctagtagtatcgtgacgacgagagagacagccctaacg

SEQ ID NO: 264949 - DNA, 532 bp, Homo sapiens
  misc_feature: GYAE6OF01A8224.34.26.C04.1.454.CMB.1.raw
  modified_base (525)..(525): a, c, t, g, unknown or other
  misc_feature (525)..(525): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccctgggactccctgacgactctcctgtgcagcgtctggattcaccttcagtagtcatggcatgcacgtgggtcccgccaggctccgaggcaaggggctgggagtgggtgcaggttatagtggtatggatgggaaagtagtcaaattactatgacagactccggtgaacgggcctattccgacccgtctaccgaagacgaacaactacccgaaagaaccacgctagtactcgtagacaaagtcgaaccagcctagagacgcgagacacggctatgtattcgtgtgacgagagagacngcctacg

SEQ ID NO: 264950 - DNA, 511 bp, Homo sapiens
  misc_feature: GYAE6OF01AN0WA.34.26.C04.1.454.CMB.1.raw
  modified_base (501)..(501): a, c, t, g, unknown or other
  misc_feature (501)..(501): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccgaggcaaggggctgggagtgggtgctagttatagtggtatgatgggaatagtcaaatactatgcagactccgtgaacgggccagttccaccgtctccgagacgacaactacccaagaacacgactgtatcagacaatcgaccagcctagacgagccgaggccaacggctatgtatcgtgtgacgagagaancgacgcgacg

SEQ ID NO: 264951 - DNA, 568 bp, Homo sapiens
  misc_feature: GYAE6OF01DFQXE.34.26.C04.1.454.CMB.1.raw
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgagactctcctgtgcagcgtctggacttcaccttcagtagtcatggcatgcacgtgggtcccgccaggcctccgaggcgaaggggctgggagtggggtgactagtttatagtggtaatggaatagggaagtagtacaaattactaagtgacaagtaccgtccggtaggaacgggccgtaatttccgacccgttctacccgaagacgaacaaactacccaaagaaccacgtctagtactcgtagacaaagtcgaaccagtccgtagacgacgaccgacggacgacgactagtagttaatcgtagngacgagagagacncgccgtacg

SEQ ID NO: 264952 - DNA, 504 bp, Homo sapiens
  misc_feature: GYAE6OF01EN6EY.34.26.C04.1.454.CMB.1.raw
  modified_base (497)..(497): a, c, t, g, unknown or other
  misc_feature (497)..(497): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcactgggtccgccaggctccaggcaaggggctgggagtgggtgcttagtatagtggtatgatggaagtgtcaatactatgcagactcgtgaaggccattcaccgtctaccagacgacaactcccaagacacgctagtatctgacaatcgaccagcctgagacgccgaggacacggctagtgtacttcgtgtgacgtagagagacngcctacg

SEQ ID NO: 264953 - DNA, 622 bp, Homo sapiens
  misc_feature: GYAE6OF01DK2BJ.34.26.C04.1.454.CMB.1.raw
  modified_base (479)..(479): a, c, t, g, unknown or other
  misc_feature (479)..(479): n is a, c, g, or t
  modified_base (523)..(523): a, c, t, g, unknown or other
  misc_feature (523)..(523): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (595)..(595): a, c, t, g, unknown or other
  misc_feature (595)..(595): n is a, c, g, or t
  modified_base (612)..(612): a, c, t, g, unknown or other
  misc_feature (612)..(612): n is a, c, g, or t
tcagtacacgtgatcacgaccggtgctcgatttagtctagcgactttgggtttggggctgggagaggagcccagcactagaggtcggcggttgtttccattcggtgatcagcactgaacacagaggactcaccatggagtttgggctgagcttgggtttttcctcgttgcttcgttttaaaggaggtgtccagttgtcaggtgcagctgggtggagtcggtgggggagcggtggcccagccgtgggacctccctgacgaccttctccgtgtcgcagtcgtctaggtactttccacccttgagttagtcagttcggactagttcgcctacggttcggggtccccaccgaggtccctaccggagggacgaacgggggtcttaggggaggttggggtagcttaagttatcggtggtatggtagtacggaaagtacgtactaaagtactagtgacctagtaccgtcggtaggacggtaccgtnttaccgaccgttctaccgagtacgaacgtaacacccgaaagacncgtctagtatcgtaananaaatcgaacacgcctaggagcgaccggtagacgacggttctagtattacgttgngtcggaagaggaagacngacgctacgg

SEQ ID NO: 264954 - DNA, 660 bp, Homo sapiens
  misc_feature: GYAE6OF01BWRVZ.34.26.C04.1.454.CMB.1.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (271)..(271): a, c, t, g, unknown or other
  misc_feature (271)..(271): n is a, c, g, or t
tcagtacacgtgatcacgaccggtgctcgatttagtctagcgactttgggtttggggctgggagaggagcccagcactagaggtcggcggtgtttccatttcggtgatcagcactgaacacagaggactcaccatggagtttgggctgagcggtcgtttcggtctaggcgtcttaagtaggngtcagtgtnaggtgcagcgtggtggagtcgtgggggagcgtggcccagcctgggacgtcctgacgctctccttgtcgcagcgtcctggngttctaccttcctacgttaggttactagtggtagtagtgcgcggttcggtccgccgcggcgacccggaaggccggtaaggggccggttcggggtacggtcgggtaggtacgtaacgtaagtagtaggtaaggtaagtaagtaaggtaaggtagtacgtaagtacgtagtacgtacgtacgtacgtacgtacggtacggtacgtacgtacgtaccgtaccgtacgtaacgaacgtacgtaacgtaaccgtaacgtaacgtacgtaacgtacgtaacgtacgtacgtaacgtaacgtacgaccgacgacgacgacgacgacgtacgacgtacgtacgtacgtagtacgttacgtacgtacgtacgtacgtacgtacgtacgtcgtcgtacg

SEQ ID NO: 264955 - DNA, 529 bp, Homo sapiens
  misc_feature: GYAE6OF01CAP2G.34.26.C04.1.454.CMB.1.raw
  modified_base (519)..(519): a, c, t, g, unknown or other
  misc_feature (519)..(519): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccaggcctgggacgtccctgagactctcctgtgcagcgtctggattcaccttcagtagtcatggcatgcactgggtcccgccaggcctccgaggcaaggggctgggagtgggtggcagtttatagtggtatggatgggaacgtagtcaaatctaatgacagactccgtagaagggccgattcacccgtctccgaagagacaatcccaaagaacacgactgtaatctagactaatcgaaccagcctagagacgccgaaggaccacggctatgtaattcgtgtagacgtagagagacncgccgtaacg

SEQ ID NO: 264956 - DNA, 538 bp, Homo sapiens
  misc_feature: GYAE6OF01BFBFQ.34.26.C04.1.454.CMB.1.raw
  modified_base (465)..(465): a, c, t, g, unknown or other
  misc_feature (465)..(465): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtggcccaggcccgtggggaccgtccctgacgacctctcctgtgcagcgtctggattcaccttcagtagtcatggcatgcacgtgggtccgccaggcctccgaggccaaggggctgggagtgggtgcagttatagtggtatgatggaagtagtcaatactatgcagactccgtggaacgggccgtattccaccgtctaccgagacgacaactacccaagaaccacgctagtactctagacaancgaacacgctagagacgccgagaccacggactagtagtacgttacgtgtcgacgagaggaagacagcctaacg

SEQ ID NO: 264957 - DNA, 511 bp, Homo sapiens
  misc_feature: GYAE6OF01CJ6D9.34.26.C04.1.454.CMB.1.raw
  modified_base (178)..(178): a, c, t, g, unknown or other
  misc_feature (178)..(178): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtctgggggagcgtggcccagcctgggacgtccctgagactctcctgtgcagcgtctggattcaccttcagtagtcatggcatgcactgggtcccgccaggcctccgaggcaaggggctagggaggtgggtggctaggttatagtggtatgatggaagtagtcaatactatgcagactccgtgaaggccatcaccgtctaccagagacaactacccaaagaacacgctagtactctgacaaatcgaccagcctagagacgccgagaccaggctatagtattcgngtgcgaganagacngctacg

SEQ ID NO: 264958 - DNA, 562 bp, Homo sapiens
  misc_feature: GYAE6OF01EF6IF.34.26.C04.1.454.CMB.1.raw
  modified_base (341)..(341): a, c, t, g, unknown or other
  misc_feature (341)..(341): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccaggcctgggacctccctgagactctcctgtgcagcgtctggattcaccttcagtagtcatggcatgcacgtgggtcccgccgaggcctccgaggcaaggggctgggagtgggngcagttatagtggtatgatggaaagtagtcaaatctatgcagtactcgtagaagggcctatcacccgtcaccagacgaacaactacccgaagaaccacgtctagtactctagacaaagtcgaaccagcctaggacgacggacccggaaggaccgacggtacgttagttagttaacttaccgtggtacggacggaaggaacgaagaacgacgcccgtaaccg

SEQ ID NO: 264959 - DNA, 605 bp, Homo sapiens
  misc_feature: GYAE6OF01D2MPG.34.26.C04.1.454.CMB.1.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagcctggggacctccctgacgacctctcctgtgacagcgtctggacttccaccttnagtagtcagtggcatcgcacgtcgggtcccnccaggcctaccgaggccgaaggggctgggagtggggcgctagtttanagtggtatcgatacgggaatagtacaaatactagtgacaggacctccggtaggaacggccgaacttccaaccgtcctacgagaacgacaactacccaaagaaccacgtacttagtatacctacggtaacaaaacgttcgaaccctacggaccgtaggaacggaccgaccggaaaggacccgaacgggtacttagtagttaacttacgtggtagacgtaggacgtaagaccacggccctaacgg

SEQ ID NO: 264960 - DNA, 573 bp, Homo sapiens
  misc_feature: GYAE6OF01C4N1K.34.26.C04.1.454.CMB.1.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (546)..(546): a, c, t, g, unknown or other
  misc_feature (546)..(546): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctgacgctctcctgtgcagcgtctggattcaccttcagtagtcatggcagtgcacgtgggtccnccgaggcctcgaggcgaagggctggagtgggngcagttanagtggtatgatggaagtagtacaaatctaagtgacacgtaccgtccggtaggaacgggccctagttccgaacccgttctaccgaacggacaaccaactacccgaaagaaccaccgtacttagtactcgtagaactaacgtcgaacccagcctaggaacgcgaccggaggaccaggtcttaagtgttaacttcgtcggtanacggtagaacggagacacgccgtaacg

SEQ ID NO: 264961 - DNA, 520 bp, Homo sapiens
  misc_feature: GYAE6OF01B3XG5.34.26.C04.1.454.CMB.1.raw
  modified_base (304)..(304): a, c, t, g, unknown or other
  misc_feature (304)..(304): n is a, c, g, or t
  modified_base (498)..(498): a, c, t, g, unknown or other
  misc_feature (498)..(498): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtcccnccagggcctccgagggcaagggggctgggagtggggtggcaggttatagtggtatggttaggaagtagtcaatactatgcagactccgtgaagggccgattcaccgtctccagagacaatcccaaagaacacgctgtactctgacaaatcgaccagcctagagacgccgaggacacggctagtgtattacgtgngcgagagagacagccacgtacg

SEQ ID NO: 264962 - DNA, 564 bp, Homo sapiens
  misc_feature: GYAE6OF01CMJ27.34.26.C04.1.454.CMB.1.raw
  modified_base (305)..(305): a, c, t, g, unknown or other
  misc_feature (305)..(305): n is a, c, g, or t
  modified_base (556)..(556): a, c, t, g, unknown or other
  misc_feature (556)..(556): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagcctgggacctccctgagactctcctgtgcagcgtctggacttcaccttcagtagtcatggcatgcacgtgggtccnccaggcctccgaggcgaaggggctgggaggtgggtgctagtttatagtggtatggagtggaatgtacaattactatcgacagtaccgtccggtaggaacgggtccgtattcccgaccgtctaccgaagacgacaactacccgaaagaaccacgtctagtaactctagaactaaagtcgaaccagtccgtagagacggaccggaggaccgacggtacttagtacggttattacgtgtaggacgagagagacncgcctacg

SEQ ID NO: 264963 - DNA, 588 bp, Homo sapiens
  misc_feature: GYAE6OF01B79EW.34.26.C04.1.454.CMB.1.raw
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagacctctcctgtgcagcgtctggattccaccttcagtagtcagtggcatcgctacgtcgggtcccnccgaggcctaccgaggccgaaggggctgggagtgggtgctagttanagtggtatgagtaggaatagtacaaattactagtgactaaggtaccgtccggtaggaacgggtccgtaacttccgacccgttctaccgaagacgaacctaactacccgaaagaaccacgtctagtactcgtacgaacaatccgaacctagccgtagacggacgaccgaggaccgacggtactagtagtaacttcgtgtacggacgaaggacgaagccgaagtccctaacgg

SEQ ID NO: 264964 - DNA, 564 bp, Homo sapiens
  misc_feature: GYAE6OF01EDS84.34.26.C04.1.454.CMB.1.raw
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (532)..(532): a, c, t, g, unknown or other
  misc_feature (532)..(532): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgtcgttagctctttaagaggtgtcagtgtcaggtgcagctggtggagtcgtgggggaggcgtggcccagcccgtgggacgtccctgacgactctcctgtgcagcgtctggattcaccttcagttagtcatggcatgcacgtcgggtccnccgaggcctccgaggcgaaggggtctgggagtgggtgcagtttanagttgggtatggatagggaaagtacgtactaaatactagtgacagtactcggagacggcgtattccgaccgtctccgagacgaacctaacgtaccccaaagaccacgtcttagtaactctacgactaaatcgacagtccagacgacggcgacgacgacgtagtacgttgtaacgttacgnggtacgacggaagagacgaacacgctaacggg

SEQ ID NO: 264965 - DNA, 561 bp, Homo sapiens
  misc_feature: GYAE6OF01AR6LF.34.26.C04.1.454.CMB.1.raw
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcacgtgggtccncaggctccgaggcaaggggctgggagtggggtggctaggttatagtggtatggatgggaatagtcaaatactatgcagactcgtgaacgggccatcacgtcncagagacaactcccaagaaccacgactgtactcgtagacctaaatcgaacccagtacccgtaggaacggacggacccggaggaaccgaccgggtcttaacgtagttaacttacgtggtaggacggtaagaacggaagaccgacgtcccgtaacg

SEQ ID NO: 264966 - DNA, 675 bp, Homo sapiens
  misc_feature: GYAE6OF01EIR8U.34.26.C04.1.454.CMB.1.raw
  modified_base (180)..(180): a, c, t, g, unknown or other
  misc_feature (180)..(180): n is a, c, g, or t
  modified_base (268)..(268): a, c, t, g, unknown or other
  misc_feature (268)..(268): n is a, c, g, or t
tcagtacacgtgatcacgaccggtgctcgatttagtctagcgactttgggtttggggctgggagaggagcccagccacgtagaggtcggcggtgtttccattcggtgatcagcactgaacacagaggactcaccatggagtttgggctgagctgggttttcctcgttgcttcttttaagnggtgtccagtgtcaggtgcagcgtggtggagtcgtggggggagcgtggcccaggcccgtgggacctccctgacgactctccgtgtgcngcgtctggattccacttcagtagtcagtggcatgcacgtcgggtccgccgaggcctaccggaggccgaaagggggcctgggaggtggggtcggacgtagttagtagttggtagtggagtaggtaagtagtactaaagttactagtcgacgtaacgtaccgtaccgggtaggtaaccggggtaccgtacgtttacccgaacccggttacccgtaacccgaaggtaaacgtaaccgtaaacctaaccccgaaaacgaacctaaccgtacgttaacgtagtcgtaacgaaccaaagttaccgaaccgtagtaccgtaggaacggaccggaccggaacggaccgacggtaccgttagttaggttacttacgtaggacgacgtaacggagaacgacgtcgacccgtaaccgg

SEQ ID NO: 264967 - DNA, 718 bp, Homo sapiens
  misc_feature: GYAE6OF01CLCUX.34.26.C04.1.454.CMB.1.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtccnccaggcctccgagggcgaaaggggtctgggaggtggggtggctaaggtttanagtgggtaatggattagggaaagttagtacaaattactagtgacctaagtaccgtccggtaggaaacggggtcccgtaagtttcccgaacccggttcctaccgaaggaaccgaacctaaacgtacccccgaaaaggaaaccctaaccggtacttacggttaaccttccgttaacggaacctaaaaacgttccgaaaccccgtaaggtaccccgttaagggaaccgggaacccggaacccggggaaacgggtaaaccccgtaccggggtaaccttaaggtttacggtttaaacgttttacccggtagggtaacgaccgggtaagggtaaacggaacggaacccgacgggtacccctaaaccggg

SEQ ID NO: 264968 - DNA, 590 bp, Homo sapiens
  misc_feature: GYAE6OF01DRACG.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagctctcctgtgcagcgtctggacttcaccttcagtagtcatggcatgcacgtgggtcccncgaggcctccgaggcaaggggctgggagtgggtgctagttatagtggtatggattggaaagtagtacaaagtactagtgactaagtccgtaccggtaggaacgggtccgtaatttaccgaacccgttctaccgaaggacgaaccaaactaccccgaaagaaccacgtacttagtaactcgacgacaaatcgacccagccgtagacgacggaccggaaggaccgacggtaccttaagtagttaagttaccgtgggtgacggtaggaacggacgaacgcgccctaacgg

SEQ ID NO: 264969 - DNA, 559 bp, Homo sapiens
  misc_feature: GYAE6OF01EFLGW.34.26.C04.1.454.CMB.1.raw
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggcccagcctgggacctccctgagactctcctgtgcagctctggattcaccttcagtagtcagtggcatgcactggggtcccgcaggcctccgaggcaaggggctgggagtgggtggcagttanagtggtatgagtggaagtagtcaaatactangcaagctcgtagaacggccgtattccgaaccgtctaccgagacacaactcccaaagacacgcttgtactctagacaaagtcgaacccaggcctagacggacgacccggaaggaaccacgggtacttaagttaggttaacttacgtcggtagacggaggaagtacgacgacgccgtaaccg

SEQ ID NO: 264970 - DNA, 608 bp, Homo sapiens
  misc_feature: GYAE6OF01COEEE.34.26.C04.1.454.CMB.1.raw
  modified_base (310)..(310): a, c, t, g, unknown or other
  misc_feature (310)..(310): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggcccaggcctgggaccgtccctgacgactctcctgtgcagcgtctggattccaccttcagtagtcatggcatgcacgtgggtccnccgaggcctccgaggcgaaggggctgggaggtggggtggctaggtttatagtgggtatgagtggaagtagtacaattactatcgacagtacctccggtaggaacgggcctaagttccgacccgtctaccgagacgacaactacccaaacgaaccacgtacttagtactcgtacgactaaacgtccgaaccacgacccttaggaacgaccggaccggaagggaacccgacgggtacttacggttagttaactttcgtggtacggaccggaaggaacggaacgaaccgacgccctaacgg

SEQ ID NO: 264971 - DNA, 531 bp, Homo sapiens
  misc_feature: GYAE6OF01C9974.34.26.C04.1.454.CMB.1.raw
  modified_base (302)..(302): a, c, t, g, unknown or other
  misc_feature (302)..(302): n is a, c, g, or t
  modified_base (438)..(438): a, c, t, g, unknown or other
  misc_feature (438)..(438): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggcccagcctgggactccctgacgactctcctgtgcagcgtctggattcaccttcagtagtcatggcatgcactgggtcccnccaggctccgaggcaaggggctgggagtgggtggctaggttatagtggtatgagtggaagttacgtacaatctaatgacaggactaccgtgaacgggcctattccgaccgtctaccagacaacatacccaagaacncgactagtatctagacaaatcgaccagtctagagacgtaccgaggacctacggctattagtacttacgtgtagcgagtagagacagcctaacg

SEQ ID NO: 264972 - DNA, 550 bp, Homo sapiens
  misc_feature: GYAE6OF01AQD3V.34.26.C04.1.454.CMB.1.raw
  modified_base (302)..(302): a, c, t, g, unknown or other
  misc_feature (302)..(302): n is a, c, g, or t
  modified_base (542)..(542): a, c, t, g, unknown or other
  misc_feature (542)..(542): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtcccnccaggctccgaggcgaaggggctgggagtggggtgctaggttatagtgggtatgagtggaagttagtcaaatactatgcagtacctccgtagaacgggccgattccgaccgtctccaagacgacaactcccaaagacacgctgtatctagactaaagtcgaacccagccctaggacgacgaccggaggaccgacgggtaccttagtacgttaattccgtagtacgacgaagacgagaccngccctacg

SEQ ID NO: 264973 - DNA, 500 bp, Homo sapiens
  misc_feature: GYAE6OF01BBUB2.34.26.C04.1.454.CMB.1.raw
  modified_base (343)..(343): a, c, t, g, unknown or other
  misc_feature (343)..(343): n is a, c, g, or t
  modified_base (403)..(403): a, c, t, g, unknown or other
  misc_feature (403)..(403): n is a, c, g, or t
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtcccgccaggctccgaggcaaggggctgggagtgggtggcagttanagtggtatgatggaagtagtcaatactatgcagactcgtgaggcattcaccgtctcaganacaatcccaagacacgctgtatctgacaagtcgaccagcctagacgacgccggaggaccgacggctatgtattcgtgngacgagagagacngctacg

SEQ ID NO: 264974 - DNA, 643 bp, Homo sapiens
  misc_feature: GYAE6OF01DOPPS.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttgggctggggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgagactctcctgtgcagtcgtctggacttcaccttcagtagtcatggcatcgcacgtgggtccnccgaggcctccgagggcgaaaggggtctaggggagtggggtggactagttatagtggtatggaatggtaaagtgtacaatacgttatcgacagtactccgtaggacgggtaccgtattccgacccggttctaccgaaggtacgaacctaactaccccgaaaagtaaccgtaccgtcttagtaaccttcgtaagtaacctaaaacgttcgaaacccgtacgacccgtaggacgaacggacccggtaaggacccgtaacgggtaccttaaggtagtttaacggttacgtcggttacggaacggtaaggaaacggaggtaaccgacggtcccgtaaccgg

SEQ ID NO: 264975 - DNA, 509 bp, Homo sapiens
  misc_feature: GYAE6OF01EBB25.34.26.C04.1.454.CMB.1.raw
  modified_base (276)..(276): a, c, t, g, unknown or other
  misc_feature (276)..(276): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (499)..(499): a, c, t, g, unknown or other
  misc_feature (499)..(499): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgacgctctcctgtgcagcgtctggattcaccttnagtagtcatggcatgcacgtgggtccgccaggcctcgaggcgaaggggctgggagtgggngcagttanatggtatgagtggaagtgtcaatctatgcagctcgagacgggctatcacgtcacagacacactaccaagaccacgcttagtactctagacaaagtcgaaccagcgtagacgacgccgaggacacggtntagtgtattcgngtcgacgtagacganacagcctacg

SEQ ID NO: 264976 - DNA, 502 bp, Homo sapiens
  misc_feature: GYAE6OF01AZWU6.34.26.C04.1.454.CMB.1.raw
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcactgggtccgccaggctccgaggcaaggggctgggagtgggtggcaggttatagtggtatgatggaagtagtacaatactatgcagactccgtagaggccgatcaccgtctccagagacaatcccaagaacacgctgtatctgacaatcgaccagcctagacgacgccgaggaccgacgctagtagtattcngtgcgagagagacngcacg

SEQ ID NO: 264977 - DNA, 742 bp, Homo sapiens
  misc_feature: GYAE6OF01CZUTK.34.26.C04.1.454.CMB.1.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggaagcccagcactagaggtcggcggtgtttccattcggtgatcagcactgaacacagaggactcaccatggagtttgggctgagtcttgggttttcctcgttgcttcttttaagaggtgtccagtgtcaggtgcagcgtgggtggagtcgtggggggagcgtggcccagccgtgggactccctggagtctctcctgtcgcagcgtctgtatcaccttnagtatcatggcatgacacgtgggtcccncacggcctccaggcgaagggtctgggagtgggtgctagttatagtggtatgagtaggaagtagacctaatactagtgacacgaccgtacggtaggaacgggtccgtattcccggaacccgtttccgaaccgtaaaggtaacgtaaccctaaacgttacccccgaaaaaggtaacccaaccggtcctttaacggttaaccttaccgtaacggtaaaccttaaaacgtaccggtaaaccccgtaacggtaccccgttaacggggaaccggtaacccgggtaacccgggtaacgggaaacccggtaaccggggttaacccgttaaaggttaccgggttttaaacgtttaaacccggtcgggtttaacccggaacgggtaaacggttaaacgggtaacccgtaaaccggacccgttaaccccgttaaccccggg

SEQ ID NO: 264978 - DNA, 530 bp, Homo sapiens
  misc_feature: GYAE6OF01AHC37.34.26.C04.1.454.CMB.1.raw
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcactgggtcccnccaggcctccgaggccaaggggctgggaggtggggtggctagttatagtggtatgagtggaagtagtcaaatactatgcagactcgtagaacggccgattcacccgtctccagacgacaactacccaaagaaccacgctgtactcgtagacaaagtcgaccagcctagacgagccgaggaccgaacggcgtagtgtattcgtgtgacgagagagacgacgcctacg

SEQ ID NO: 264979 - DNA, 615 bp, Homo sapiens
  misc_feature: GYAE6OF01CFSU2.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggaggcgtggcccagcctgggacgtccctgagactctcctgtgcagcgtctggattcaccttcagtagtcatggcatgcctacgtggggtcctcacggctccgaggcgaaggggctgggagtgggtgctagttatagtggtatgataggaaagtagtacaaatacttatgactaggtacctccggtaggaacgggtccgtacgttaccacccgtctaccgaagacgaacaaacctacccgaaagaaaccacgtacgttacgtactacgtacgactaaacgtcggaaccctaggtcccgtaaggacgaacggacccggaagggacctaaccgggtcttaacgttagttacgtttacgacggttacgacggtaacgaacggagaaccgacggtccctaacg

SEQ ID NO: 264980 - DNA, 612 bp, Homo sapiens
  misc_feature: GYAE6OF01AX304.34.26.C04.1.454.CMB.1.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgacgctctcctgtgcagcgtctggattcaccttcagtgtcagtggcatgcacgtcgggtccnccgaggcctccgaggccgaaggggtctgggaggtgggtgctagttangtggtatgagtggaaatgtacaattactagtcgacacgtaccgtcgtaggaacgggtccgtacgtttccgaacccggttcctacccgtaacggaacgtaaccaaactacccgaaacgaacccaccgtacttacggtactcgtacgaacctaaagtcgaacccgacgtaccctaggaacgacggacccggaacggaccgaccggtacgtagttacgtacgtttacgtcggtagacggagaacggaagaccgcgccgtaacg

SEQ ID NO: 264981 - DNA, 579 bp, Homo sapiens
  misc_feature: GYAE6OF01C0IZZ.34.26.C04.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctgggtggagtcgtgggggagcgtggcccagccgtgggacctccctgagactctcctgtgcagcgtctggattccaccttnagtagtcatggcatgcacgtgggtcccnccgaggcctccgagggccgaaggggctgggaggtggggtggactaggtttaatagttgggtatggaagtacgggaaagttagtacaaattactatggacaggacctcggaggaacggccgtatccaccgtctacccgagaacgaaccaactacccgaaagaaccacgtactgtaactctagacaaactcgaaccgacgcgtagagacggaccgacggacgtacgctagtattattacgtgtagacgaggagaacgacgagcccgtaacg

SEQ ID NO: 264982 - DNA, 636 bp, Homo sapiens
  misc_feature: GYAE6OF01B26D4.34.26.C04.1.454.CMB.1.raw
  modified_base (177)..(177): a, c, t, g, unknown or other
  misc_feature (177)..(177): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagcctgggaccgtcctgacgactctccngtgcagcgtctggattccaccttcagtagtcagtggcatcgctacgtcgggtccnccaggcctcgaggcgaaggggctgggacgtgggcgctagttatagtggtangaacgtgggaaattagtactaaattacgtagtcggactaacggtaccgttaccgggaggaacgggtccgtactttacccgaaccccgttcgtacccgaagtaacgtaacctaaacgtccccgaaaagaaccctacggtcttagtaactcgtacgaactaaacgtccgaaccgacgtccgtaaggacggaccgtacccggaaggaccgtacggtacttacgtagttaacttccggtaggtacggacggtaagacggaagaccgaccgtccgtaacgg

SEQ ID NO: 264983 - DNA, 502 bp, Homo sapiens
  misc_feature: GYAE6OF01AUJ2G.34.26.C04.1.454.CMB.1.raw
  modified_base (302)..(302): a, c, t, g, unknown or other
  misc_feature (302)..(302): n is a, c, g, or t
  modified_base (496)..(496): a, c, t, g, unknown or other
  misc_feature (496)..(496): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgacactgggtccnccaggcctccaggcaaggggctgggagtggggtggcagttatatggtatgatggaagtagtcaatactatgcagactcgtgaaggccgattcaccgtctccagagacaatcccaagaaccacgctgtatctgacaaatcgaccagcctagagacgccgaggaccacggctagtgtattctgtgcgagagagacngccacg

SEQ ID NO: 264984 - DNA, 539 bp, Homo sapiens
  misc_feature: GYAE6OF01BVCCD.34.26.C04.1.454.CMB.1.raw
  modified_base (304)..(304): a, c, t, g, unknown or other
  misc_feature (304)..(304): n is a, c, g, or t
  modified_base (509)..(509): a, c, t, g, unknown or other
  misc_feature (509)..(509): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggaccgtccctgagactctcctgtgcagcgtctggattcaccttcagtagtcatggcatgcacgtgggtccnccaggcctccgaggcaaggggctgggagtggggtgcagttatatggtatggatggaaagtgtacaatactaatgacagactccggtagaacgggccgattccaccgtctaccgagagacaactacccaagaaccacgctagtaatctagacaaatcgaaccagccctaggacgacgccggaggacacggctagttcgtattacgnggtaggacgaaggacgaagctagcctaacg

SEQ ID NO: 264985 - DNA, 570 bp, Homo sapiens
  misc_feature: GYAE6OF01D2VPM.34.26.C04.1.454.CMB.1.raw
  modified_base (560)..(560): a, c, t, g, unknown or other
  misc_feature (560)..(560): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggcccagccctgggacctccctgacgacctctcctgtcgcagcgtctggattcaccttcagtagtcagtggcatgcacgtggggtcccgccaggcctccgaggcgaaggggctgggaggtggggtgctaggttatagtggtatgatgggaaatgtacaatactagtgcaagtactccggtaggaacgggcctattccacccgttctaccgaagacgacaactacccaaagaccacgtctagtactctacgactaaagtcgaaccagcccgtagacgacgccgaaggtaccacggtctaagttgttaattacgtggtacgacggaaggagaacgacncgccctaacg

SEQ ID NO: 264986 - DNA, 671 bp, Homo sapiens
  misc_feature: GYAE6OF01A7D3B.34.26.C04.1.454.CMB.1.raw
  modified_base (178)..(178): a, c, t, g, unknown or other
  misc_feature (178)..(178): n is a, c, g, or t
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
  modified_base (500)..(500): a, c, t, g, unknown or other
  misc_feature (500)..(500): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagctgggttttcctgttgcttcttttaagnggtgtccagtgtcaggtgcagcgtggtggagtcgtgggggagcgtggcccaggccgtggggacctcctgacgctctccgtgtgacagcgtcgtaggacttcaccgttnaggtacgtcagtggccagtcgctacgtcgggtcccgaccnggcctaccgaggccggaaaggggtcctgggaggttggggtcgacgtaaggtttatagtgggtatggagtacgggaatacgtacaaaattcgtaagtggccaaggtccgtaccggtgaaacgggcctaagttccgacccggttcacgaagaacgtaacaactacccgaagaaccncggacgttagtacgtctaacgtaacctaaaagttccgaacctaaccggtccgtaacgacggaaaccggtaccgggaaacgggaccgaacgggtaacccgttagttacggtaacttaacgggtcggttacggaacggtaacggtaaggaacgacgtaccggaccgtaaccgg

SEQ ID NO: 264987 - DNA, 569 bp, Homo sapiens
  misc_feature: GYAE6OF01ARFSB.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacctccctgacgactctcctgtgcagcgtctggattccaccttcagtagtcagtggcatcgctacgtcgggtcccgccgaggcctccgaggcgaaggggctgggaggtgggtgactagttatgtggtatgatggaagtagcaatactatgcagactcgtagacggcctatcgaccgtctcgagacgacactaccaagacacgctagtactctagactaatacgaaccacgccgtagacgacgaccggacggaccgtaccgggtcttaacggttgttaacgttacgtacggtacgaaccggaaggaacgaaccgaacgccgtacccgtaaccgg

SEQ ID NO: 264988 - DNA, 555 bp, Homo sapiens
  misc_feature: GYAE6OF01A7CU9.34.26.C04.1.454.CMB.1.raw
  modified_base (548)..(548): a, c, t, g, unknown or other
  misc_feature (548)..(548): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacctccctgacgactctcctgtgcagcgtctggacttcacctttcagtagtcatggcatgcacgtggggtcccgccaggcctaccgagggccaaggggctgggagtgggtggctagttatagtggtatggatgggaaagttagcaaatactatgacaagactccggtaggaacgggccgtattcaccgtctaccgaagacgaacaactacccaaagaacacgtactgtatcgtagacaagtacgaccagtcctaggacgacgccggaaggaccgaacggcgtattacgtaacttcgtgtgacgagacgacgacncgctacg

SEQ ID NO: 264989 - DNA, 594 bp, Homo sapiens
  misc_feature: GYAE6OF01EJ1C8.34.26.C04.1.454.CMB.1.raw
  modified_base (490)..(490): a, c, t, g, unknown or other
  misc_feature (490)..(490): n is a, c, g, or t
  modified_base (567)..(567): a, c, t, g, unknown or other
  misc_feature (567)..(567): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtgggtggaggttcggtggggggaggccggtcgggccccgaggcccgttgggggaccgttcccctggacgtaccttcttccgtggtgccaggcgttctggtactttccacctttcagttagtcagtggcatcgcacgtcgggtccgccaggcctccgagggcgaaggggctgggagtggggtgactagttagattggtatgagtggaaagtagtacaaattactatgacagtaccgtcggtagaacgggcctattccgacgtctaccagacgacaactacccaaagacncgtactgtactctagaacaagtcgaccgacgtacctaggacgacgaccggaagaccgaggtctagtagtacttacgngtacgacggagagacgacacgcgtacg

SEQ ID NO: 264990 - DNA, 555 bp, Homo sapiens
  misc_feature: GYAE6OF01EJVR5.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccctgggacgtccctgagactctcctgtgcagcgtccggattcaccttcagtagtcatggcatgcacgtggggtcccgccagggcctccgagggccgaaggggctgggaggtgggtggcagttatagtggtatgagtggaagtagtcaatactatgacagactccggtaggaagggccgtattccgacccgttctaccgaagagaaccaactaccccaaagaaccacgctagtaactctagacaaatcgaaccagccctagacgacgccgaaggaccacgggacttagtgttattacgtgtgacgagaacgacgacagcccagtcgg

SEQ ID NO: 264991 - DNA, 521 bp, Homo sapiens
  misc_feature: GYAE6OF01E1DBA.34.26.C04.1.454.CMB.1.raw
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcactgggtccgccaggctccgaggcaaggggctggagtgggtggcagttatatggtatgatggaagtagtcaaatactatgcagactccgngaggccgattccaccgtcnccagacgacaatacccaagaaccacgctgtactcgtcgacaaatcgaccagccgtgaggacgcgaggaccgaccggcgtatgttaacttcgtgtgacgacggaagagaacagcctacg

SEQ ID NO: 264992 - DNA, 630 bp, Homo sapiens
  misc_feature: GYAE6OF01CA9N2.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttcctcgttagctctttaagaggtgtccagtgtcaggtgcagctggtggagtcgtgggggagcgtggcccagccgtgggactccctgagctctcctgtgcagcgtctggattcacttcagtagtcagtggcatcgcacgttcgggccaccgacggcctccgaagggacgaaggggcgttgggaggtggggttgcagttatagtggtaatggatggaaagtagtacaagtaactgtagcgagtacgtccgtaggaacgggtccgattcgacccgtctacccgagacgacctaaagtcccaaacgaactacggcttacggtaatccgtataaccgaaagttacgaacccgtagtacccgtagggacgaacggacccggaaacggaccgtaaacgggtcccttaagttacgtttaacgttaacccgtgggttaacggaccgaaggtaaacggacctaaaccggcgacccgtaaccgg

SEQ ID NO: 264993 - DNA, 624 bp, Homo sapiens
  misc_feature: GYAE6OF01C2UAV.34.26.C04.1.454.CMB.1.raw
  modified_base (377)..(377): a, c, t, g, unknown or other
  misc_feature (377)..(377): n is a, c, g, or t
  modified_base (584)..(584): a, c, t, g, unknown or other
  misc_feature (584)..(584): n is a, c, g, or t
  modified_base (598)..(598): a, c, t, g, unknown or other
  misc_feature (598)..(598): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgtggtttcctcgttagctcgtttaagaggtgtccagtgtcaggtgcagcgtggtgggagtcgtgggggacgcggtgcccagcctgggacctccgtgacgctcgtccgtgtcgacagtccgtcgtaggtactttccaccctttgagttacgtccagtcggcagtcggacgacgttcgggcccgcgtaggtcctccgaagggccgaaggggtcttgggagtgggtgntaggttatagtggtaatggtataggtaagtacgtactaagttactagtcgactacggtccgttacggaggaaccggtctaacgttacccgaaccgtcctaaccgagtaacgaccaacgtaccccgaaagacccgtaaccggtctaaggtactcgtagaacgtaaacgtccgaaccgagtcgtagacgtacggacgacggacgtacgnttaagtgtattcgngtgacggtagagcaacgcgcgtacgg

SEQ ID NO: 264994 - DNA, 635 bp, Homo sapiens
  misc_feature: GYAE6OF01CY64J.34.26.C04.1.454.CMB.1.raw
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtggggacctccctgagactctcctgtgcagcgtctggacttcaccttnagtagtcatggcatgcacgtgggtccnccgaggcctcgagggcgaaggggctgggagtggggtgctagttatagttgggtatggagtagggaagtagtacaaattactagtcgacagtaccgtaccggtaggaacgggcctaattcccgacccgttctacccgaaggacgaaccaactacccgaaagaacctaccgcttaggtactcgtacgaactaaacgtcgaacccaggtcctagggaacgacgggacccggtaagggacccaacgggttaccttaagttaggtttaaaccgtttacgtcgggtacggaccggtaaagggaaggtaaccggaaccgacggtaccctaaccgg

SEQ ID NO: 264995 - DNA, 554 bp, Homo sapiens
  misc_feature: GYAE6OF01AKPCZ.34.26.C04.1.454.CMB.1.raw
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagacctctcctgtgcagcgtctggattcaccttcagtagtcatggcatgcacgtgggtccnccaggcctccgaggcgaaggggctgggagtggggtgctagttatagtgggtatggatagggaagtagtacaaattactagtgacaggacctccggtaggaacgggccgtattccgacccgtctaccgagacgacaactacccaagaacacgctagtactctacgacaaatcgaaccagcctaggacgacgccgaaggaccacggtactagtagttaacttcgtgtacgacgtaggagagacacgcctacg

SEQ ID NO: 264996 - DNA, 661 bp, Homo sapiens
  misc_feature: GYAE6OF01CF571.34.26.C04.1.454.CMB.1.raw
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagctgggttttcctcgttgctcttttaagaggtgtccagtgtcaggtgcagctggtggagtcgtgggggagcgtggcccagccgtgggaccgtccctgacgcctctcctgtcgcagcgtctggattcacctttagcagctatgccatgagcgtgggtcccnccacggcctccggagggaaggggctgggagtgggtctacgtaacttagttagtgggtagggtgggtaggttaggcaacgtattaaccgaccgcaacggtaccgtccggtaggaacgggtcccggttccacctactcctacccgaagaacgtaactaaacttaccgaacgaaacctaccgtaccttgtttctacgactaacgtacgaacacgcctaggagacggaccgaacgggaccaccgggtaccgtaagtaccgtaacgtacggtacggtaacgaaaggtacgttaggtacgtaaccggtaaaccgggtttactacgggttacgggttaccgggggtacgttaacccccggg

SEQ ID NO: 264997 - DNA, 506 bp, Homo sapiens
  misc_feature: GYAE6OF01BKICO.34.26.C04.1.454.CMB.1.raw
  modified_base (435)..(435): a, c, t, g, unknown or other
  misc_feature (435)..(435): n is a, c, g, or t
  modified_base (486)..(486): a, c, t, g, unknown or other
  misc_feature (486)..(486): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtccgccaggctccgaggcaaggggctgggagtgggtgcagttatagtggtatgatggaaatagtcaaatctatgcagactcgtgaacgggccgattcaccgtctcaagacgacaatcccaagaacacgctgtactcgngacaaatcgaaccagcctagagacgccgaagacacggctagtgtatactgngacgagagagacacgccacg

SEQ ID NO: 264998 - DNA, 529 bp, Homo sapiens
  misc_feature: GYAE6OF01CO8X5.34.26.C04.1.454.CMB.1.raw
  modified_base (305)..(305): a, c, t, g, unknown or other
  misc_feature (305)..(305): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctgagactctcctgtgcagcgtctggattcaccttcagtagtcatggcatgcacgtgggtccnccgaggcctccgaggcaaggggctgggagtgggtgctagttatagtggtatgatggaatgtacaattactatgacaggacctccggtaggaacgggcccgtattccgacccgttctaccaagacgaacaaactacccaaagaaccacgctgtatctagacaaatcgaccagcctagagacgcgaggacacggctatgtattctgtcgagaganagacngccacg

SEQ ID NO: 264999 - DNA, 661 bp, Homo sapiens
  misc_feature: GYAE6OF01DCJVX.34.26.C04.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (394)..(394): a, c, t, g, unknown or other
  misc_feature (394)..(394): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcncgtagctctttaagaggtntcagtgtcaggtgcagctggtgagtcgtgggggagcgtggcccagcctaggggacgttccctggaagtacttctccgtgtgcagcgttctggattcaccttnagtatnagtgctatgcgacgtcggtccgcgagtcncgaggacgtaagggngtaggaggtgggtcgtatagttataggtgtagtggtagtaggtaagtacgtactaaatacgtanacgacgtacgtaccgtacggtacggaacggtcctacgttaccgaccgttaccgtaacgaaggtaacgaacgaaccgtaaccgaaacgtaaaccgacgttactagtaacgtacgtaacgaacgtaaacgtaaccgtaaccgtaaccgtaccggtacggaacggaacggaaccggaacggaaccggtaaccggtaacgtaacgttaagttaacgttacgttacggtacggtacggtaacggaacggaacgaacgtaccgtaccgtaccg

SEQ ID NO: 265000 - DNA, 622 bp, Homo sapiens
  misc_feature: GYAE6OF01ARIOX.34.26.C04.1.454.CMB.1.raw
  modified_base (176)..(176): a, c, t, g, unknown or other
  misc_feature (176)..(176): n is a, c, g, or t
  modified_base (310)..(310): a, c, t, g, unknown or other
  misc_feature (310)..(310): n is a, c, g, or t
  modified_base (585)..(585): a, c, t, g, unknown or other
  misc_feature (585)..(585): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttcctcgttgctctttaagnggtgtccagtgtcaggtgcagcgtggtggagtcgtgggggagcgtcggcccagccgtgggacctcctgacgactctctgtgcagcgtctggattccaccttcagtagtcagtcggcatcgcacgtcgggtcccnccgaggcctccgagggcaaggggctagggaggtggggtgacgtagttaatagtcggtagtgaagtacggaagttagtacaaattacgtagtcgactaggaccgtcggtaggaacgggtaccgtacgttccgtaacccgttcctaccgaagtaaccgaacgtaaactacccgaaacgaacaaccgtcgtacgtactacgtgaactaacgtacgaacccgtagacctacggaacgacggaccgtacggaccgacggactaggtacgttacttacggngtagacggtaacgaagaaggaacctagcccgtaacgg

SEQ ID NO: 265001 - DNA, 600 bp, Homo sapiens
  misc_feature: GYAE6OF01DKDY4.34.26.C04.1.454.CMB.1.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtggcccagccgtgggacctccctgagacctctcctgtgcagcgtctggattcacctttnagtagtcatggcatgcacgtgggtccnccaggcctccgaggccgaaggggctgggaggtggggtgactagttatagtggtatgagtacgggaatagtacaaattactagtgcaagtaccgtcgtaggaagggcctattccgaccgttctaccaggtacaaccaactacccgaaagaaccacgtctagtactacgtacgaactaaacgtcgaacctacgcctaggacgacggacccggaaggaaccgtacgggtacttacgtaggttaactttcgtaggtacgacggaaggaacggtagaaccgtacgcccgtaaacgg

SEQ ID NO: 265002 - DNA, 616 bp, Homo sapiens
  misc_feature: GYAE6OF01EBGY9.34.26.C04.1.454.CMB.1.raw
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctgggtggagtcgtggggggagcgtggccccagcccgtggggacctccctgagcctctcctgtncagcgtctggacttccaccttcagtagtcagtggcattcgcacgtggggtcccnccagggcctccgagggcgaagggggtctggggaggtggggtgctaggttatagtggtatgagtggaatagtacaaatctatgcaagctccggtagaacgggcctattccacgttcctaccagacgacaactacccaaagaaccacgcttacgtatctagaactaaagtcgaaccgacgtccgtaggacggacggacccggaacgggaccgaaccgggtacttaaggttacgttacgtttaacggtcggttacggacggaaacggtaacggaacgtaacccggagtccccgtaaacgg

SEQ ID NO: 265003 - DNA, 629 bp, Homo sapiens
  misc_feature: GYAE6OF01A1TG1.34.26.C04.1.454.CMB.1.raw
  modified_base (179)..(179): a, c, t, g, unknown or other
  misc_feature (179)..(179): n is a, c, g, or t
  modified_base (309)..(309): a, c, t, g, unknown or other
  misc_feature (309)..(309): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggcccagcctgggacctccctgagactctcctgtgcagcgtctggattccaccttcagttagtcagtggcatgcacgtgggtcccncaggcctccgaggcaaggggctgggagtgggtgctaggttatagtggtatgatgggaaagtagtacaaattacgtagtcgactaaggtaccgtccggtaggaacgggtccgtaacgtttaccgaaccccgttcctacccgaaggtaacgaacctaactaccccgaaagaaccgacgtacttaggtactacgtagaacaaacgtcgaaccgacgtaccgtagacgaccggaccgaacgggtaccgacgggtacttaacgttggttaacttacgttaggtacggtacggacggtaacggaacgaaccgaggtcccgtaacgg

SEQ ID NO: 265004 - DNA, 900 bp, Homo sapiens
  misc_feature: GYAE6OF01AIHCZ.34.26.C04.1.454.CMB.1.raw
  modified_base (160)..(160): a, c, t, g, unknown or other
  misc_feature (160)..(160): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcgtgggtttccncgttgctctttaagnggtntccagtgtcaggtgcagctggtggagtcgtgggggagcgtggcccaggcccgttggggacctcccgtggacgtaccttcgtaccgtggtcgccgaggtccgttacgtaggtacttccgaaccgtttcgaaggttacgtccgtaagtcgggacctagttcggaccgtacggtcggggttacccgacgtaacggggtccttaccggaagggtaccgaaacgggggtctacgggggtaacggttcgggggttacgaccgttaagggttttaacgtacggttcggggttaaacgttcgggtaaacggtttacggggtaaacggtttacggttaaccgtaaaacgtttaaccggttaaggtaccgggtaacccggtaacgggtttaacccgggttacccggggttaagggtaaacccggggttaccccgttaacggtttaccccggtaaccccggtttaaccggttacccggtaaacgggttaaacccggtaacccgttaaaccggttaaccccgaaaacgggttaacccgtaccggtacgtttacggttaaccgttacggtaacgtaaccgtaacgttaccgggtaacctacggtaccgtacggaacggtaccggtaccgggtaacggtaaccgtacgggtaaccgttacggtaacggttaaccgttacggtacggtacgtaccgggtaacggtaacggtaacgacgtaaccggtccgtaaccgg

SEQ ID NO: 265005 - DNA, 537 bp, Homo sapiens
  misc_feature: GYAE6OF01CF7DD.34.26.C04.1.454.CMB.1.raw
  modified_base (303)..(303): a, c, t, g, unknown or other
  misc_feature (303)..(303): n is a, c, g, or t
  modified_base (529)..(529): a, c, t, g, unknown or other
  misc_feature (529)..(529): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggcccagcctgggacgtccctgagactctcctgtgcagcgtctggattcaccttcagtagtcatggcatgcactgggtccnccaggcctccgaggcaaggggctgggagtgggtggcagttatatggtatgatggaagtagtacaatactatgacagactccggtaggaacgggccgtaattccacccgttctaccgaagacgacaactacccgaaagaaccacgtctagtactctgacaaatcgaaccagcctagacgacgccgaggaccgacggctagtgttacttcgtgagacgagagaagacngccctacg

SEQ ID NO: 265006 - DNA, 533 bp, Homo sapiens
  misc_feature: GYAE6OF01BCLGU.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcttggggaggcgtggcccagcctgggacctccctgagactctcctgtgcagcgtctggattcaccttcagtagtcatggcatgcacgtgggtccnccaggctccgaggcaaggggctgggagtgggtgctagttatagtggtatgagtggaaagtagtacaaatactatgcaagacgtccgtagaacgggccgtattccgacccgtctaccgaagacgaacaactacccgaaagaaccacgtctagtatctagaacaatcgaccagcctagagacgcgaggacacggctaagtgtaacttcgtgtgacgagagagacagcctacg

SEQ ID NO: 265007 - DNA, 642 bp, Homo sapiens
  misc_feature: GYAE6OF01AR8UW.34.26.C04.1.454.CMB.1.raw
  modified_base (161)..(161): a, c, t, g, unknown or other
  misc_feature (161)..(161): n is a, c, g, or t
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (605)..(605): a, c, t, g, unknown or other
  misc_feature (605)..(605): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttccncgttgctcttttaagaggtgtccagtgtcaggtgcagctggtgagtctgggggagcgtggcccagcctgggacgtccctgagactctcctgtgcagcgtctggactttcaccttcagtagtcatcggcatgctacgtcgggtcccnccaggctaccgaggccgaagggggctgggacggttggggnggctaggttaactagttgggtatggaagttgggaaagttacgtacaaattactagtacggcaaggtaccttacccggtaggaacgggtccgtactttccgaacccggtctacccgaaagtaacgaacctaaaccttacccgaaaacgtaaccaccggcgttagtaactctagaccaaactcgaacccgagcccgtaggtacggacggaccgggtaacggaaccgaaccgggtacttacgttaacgttacgtttacggngttacggacgagtaacggacgaacgtacgaccgtacg

SEQ ID NO: 265008 - DNA, 542 bp, Homo sapiens
  misc_feature: GYAE6OF01EC4GK.34.26.C04.1.454.CMB.1.raw
  modified_base (304)..(304): a, c, t, g, unknown or other
  misc_feature (304)..(304): n is a, c, g, or t
  modified_base (533)..(533): a, c, t, g, unknown or other
  misc_feature (533)..(533): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtggggtcccnccgaggcctccgaggcgaaggggctgggagtggggtgcagttatagtggtatgagtggaaagtgtacaaatactatgacagactccgtagaacgggcctattcgaccgtctaccgagacgacaatacccaaagaacacgctagtatctgactaaagtcgaaccagcctaggagacggaccgaaggaccacgggactagttagttaattcgtgtgacggagaacgagacngccctaacg

SEQ ID NO: 265009 - DNA, 527 bp, Homo sapiens
  misc_feature: GYAE6OF01DBKFP.34.26.C04.1.454.CMB.1.raw
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtccgccaggctccgaggcaaggggctgggagtggggtgcagttatagtggtatgatggaagtagtacaattactagtgacagacctccggtagaacgggccgtattccgacccgtctaccgaagacgacaactacccaaagacacgctgtactctagacaatcgaccagctagacgacgccgaggacncggactagtgtattcgngtgacgagagagacngcctacg

SEQ ID NO: 265010 - DNA, 605 bp, Homo sapiens
  misc_feature: GYAE6OF01DG72S.34.26.C04.1.454.CMB.1.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
  modified_base (591)..(591): a, c, t, g, unknown or other
  misc_feature (591)..(591): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggactccctgagacctctcctgtgcngcgtctggattccaccttcagtatcatggcatcgcctacgtcgggtcccnccgaggcctcgaggcgaaggggctgggaggtgggtgactaggtttanagtggtatggacgtgggtaaagtagtactaaagttactagtacgaccgaagtacccgtaccggtaaggaacgggtcccgtaagttccgacccgttacctaccgtaagaacgaacaaccgtaaccaaacgaaccacgtctacgtatctagacaagtcaccgtacgacgtagacgacgtaccgaggaccgacggtacttagtagttacttacgtggtacgacggtaagacggaanacgacgccgtaacg

SEQ ID NO: 265011 - DNA, 517 bp, Homo sapiens
  misc_feature: GYAE6OF01DDBQ1.34.26.C04.1.454.CMB.1.raw
  modified_base (299)..(299): a, c, t, g, unknown or other
  misc_feature (299)..(299): n is a, c, g, or t
  modified_base (508)..(508): a, c, t, g, unknown or other
  misc_feature (508)..(508): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagctctcctgtgcagcgtctggattcaccttcagtagtcatggcatgcactgggtccnccaggctccagggcaaggggctgggagtgggtggcagttatagtggtaatgatgggaagtagtacaatactatgcagactcgtgaggcgatcacgtctcagcgacaatcccaaagaaccacgctacgtatctagacaaatgaccagcctaggagacgaccggaggaccgacggcgtaatgttaattacgtgtagcgtaagaaggagacngccctaacg

SEQ ID NO: 265012 - DNA, 624 bp, Homo sapiens
  misc_feature: GYAE6OF01BO1H3.34.26.C04.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgactctcctgtgcagcgtctggattccaccttcagtagtcatggcatgcacgtgggtccnccaggctccgaggcaaggggctgggagtgggtgctagttanagtggtatgatggaatgtacaatactatgactagaccgtccggtaggaacgggtccgtaagttaccgacccggttacctaccgaaggaacgtaaccaaacgtaccccaaagaaccaccgtacttagtaactcgtacgaacaaacgtccgtaaccacgtacccgtaggaacgaccggacccggaacggaaccgtaaccgggtacttaaacgttagttaacgttaccgtggtaccggacggtaacggaacggtaaccggaacgaccggtcccgtaaacggg

SEQ ID NO: 265013 - DNA, 657 bp, Homo sapiens
  misc_feature: GYAE6OF01BHES6.34.26.C04.1.454.CMB.1.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctctttaagaggtgtccagtgtcaggtgcagcgtggtggagtcgtgggggagcgtggcccagccgtgggacgtcccngacgctccgtcctgtgacagcgtctggtacttcaccttnagtagtcagtcggcagtgacacgtgggtcccnccaggcctccgagggacgaaggggctgggaggtgggtcgactaggttataagtcggtatggagtacgggaaagttagtactaaattactaagtcgactacggtacgtaccggtaggaacggtccgtacttcgaaccccgtcgtaaccgtaacggaacgtaaccgtaaacctacccgaaaacgacgaaccggtacttacgtactacgacgtaaccaaagtacgaaccctggaccttaggaacgaaccgggtaccgaacggtaccgtaaccggtactaggtttaaccgtattacccgtaggtaccgaggtaacgacggtaacgtaccgaacggccgtaaaccgg

SEQ ID NO: 265014 - DNA, 551 bp, Homo sapiens
  misc_feature: GYAE6OF01BZGK7.34.26.C04.1.454.CMB.1.raw
  modified_base (304)..(304): a, c, t, g, unknown or other
  misc_feature (304)..(304): n is a, c, g, or t
  modified_base (462)..(462): a, c, t, g, unknown or other
  misc_feature (462)..(462): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggcctgggacgtccctgagactctcctgtgcagcgtctggattcaccttcagtagtcatggcatgcacgtgggtccnccaggctccgaggcaaggggctgggagtgggtggctagttatagtggtatgagtggaagtagtcaatactatgcagactccggtagaacggccgattccgaccgtctccgagtacgacaactaccgaagaacacgtctgtatcgagacaatcgaaccngaccctaggacgacggaccggaggaccaccgggtctacgttggtaacttcgtggtcggtacgaacgagaacggacgacgtcccgtaacg

SEQ ID NO: 265015 - DNA, 546 bp, Homo sapiens
  misc_feature: GYAE6OF01D5X6I.34.26.C04.1.454.CMB.1.raw
  modified_base (311)..(311): a, c, t, g, unknown or other
  misc_feature (311)..(311): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggcccagccctgggaccgtccctgacgactctcctgtgcagcgtctggattccaccttcagtagtcatggcatgcacgtggggtccnccgaggcctccgagggcgaaggggctgggaggtggggtgctagttatagtggtatgatgggaagtagtacaatactatgacaagtactccggtaggaacgggcctattccaccgtctaccagacacaactaccccaaagaccacgtctagtactctagacaaagtcgaaccagcctagacgacgaccgaggaccacggctagtgtattcgngtgacgagaaganaacngcctacg

SEQ ID NO: 265016 - DNA, 592 bp, Homo sapiens
  misc_feature: GYAE6OF01C8QHO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcactgggtccgcacggctccgaggcaaaaggggctgggagtgggtggcagttatagtggtatgagtaggaagtagtcaatactatgacagactcgtagaagggtccgagtcaccgtctacagtagacaactaccaaacgaacacgactagtatacgtacgactaaacgtacgaccgacgccgtagacggaacggacccggaacgggaaccgtacgggtaaccgtaacgttagttaacgtttaaaccgttcggttacggacggtaacgggaacggaaggtaaccacggtacccgtaaacccgg

SEQ ID NO: 265017 - DNA, 636 bp, Homo sapiens
  misc_feature: GYAE6OF01C20CX.34.26.C04.1.454.CMB.1.raw
  modified_base (177)..(177): a, c, t, g, unknown or other
  misc_feature (177)..(177): n is a, c, g, or t
  modified_base (309)..(309): a, c, t, g, unknown or other
  misc_feature (309)..(309): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagccgtgggacctccctgagactctcctgtgcagcgtctggattccaccttcagtagtcatggcatgacctacgtcgggcccncgaggcctaccgaggccgaaaggggtctagggaggtgggtggactaaggtttatagtcgggtaatggtagtagggaaacgttagtactaaagttaccgtaatcggactaacggtaccgttccggtagggaaacgggtccgtaatttacccgaccgttcctaccgaagtaacgaaccctaaacgtaccccgaaagaaccctcgtacctagttactcgtacgaactaaagtcgaacccagtcccgtagacggaaccgccggaacggaccgtacggacttagtgttaacttcgtggtagacgaaggtaacgagtaccacgtccctaacgg

SEQ ID NO: 265018 - DNA, 682 bp, Homo sapiens
  misc_feature: GYAE6OF01AUVCH.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgagctctcctgtgcagcgtctggattcaccttcagtagtcatggcatgcctacgtcggggtcccnccgagggcctccgagggccgaaggggctggggagtggggtggctagttatagtgggttatggatgggaagttagtactaaagttactagtgacctagaccgttccggtaggaacgggcccgtaagttcccaaccccggtctacccgaaggtaacgaacccaacgttaccccaaaacgaaccgaaccggtcttagtacgttaccgtacgaactaaacgtccgaaccctacggtaccccgtaggtaacggaccgggtaaccgggaaacgggacccgtaaccggggtccttaaaggttacggttaaacgtttacccgtagggttacggaacgggtaaacgaacgggtaacggaacccgaaccggtaccccgtaaaccgg

SEQ ID NO: 265019 - DNA, 707 bp, Homo sapiens
  misc_feature: GYAE6OF01C5NQC.34.26.C04.1.454.CMB.1.raw
  modified_base (314)..(314): a, c, t, g, unknown or other
  misc_feature (314)..(314): n is a, c, g, or t
  modified_base (691)..(691): a, c, t, g, unknown or other
  misc_feature (691)..(691): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagcttgggttttcctgttgcttcttttaagaggtgtccagtgtcaggtgcagctggtggagtcgtgggggagcgtggcccagccgtgggactccctgagctctcctgtgcagcgtctggacttcaccttcagtagtcagtggcagtcgacctacgttcggggtccccncgacggccctaccggagggaccgaagggggtctaggggaggttggggtagactaaggtttataggtgggttaatgggtaagtacgggtaaagttacgtaactaaagtttactagtcgaccgtaacggtaccgttaccggtagggaaccgggtaccgtaacgttacccgaacccgttccgtaaccgaaggaaccgaacctaaaccgtaaccccgaaacgaaccaccggtacttaagtactacgtacgaactaaacgttccgaacccgacgacccgttaaggacggaaccggacccggaaacgggacccgtaacgggtacttaacggttacgttaacgttaccgtacggttacggacggtaaggaaacggacgaaaccncggtaccccgtaacgg

SEQ ID NO: 265020 - DNA, 808 bp, Homo sapiens
  misc_feature: GYAE6OF01BLY3F.34.26.C04.1.454.CMB.1.raw
  modified_base (689)..(689): a, c, t, g, unknown or other
  misc_feature (689)..(689): n is a, c, g, or t
tcagtacacgtgatcacgaccggtgctcgatttagtctagcgactttgggtttggggctgggagaggagcccagcactagaggtcggcggtgtttccattcggtgatcagcactgaacacgagacgacacactagtaggttaggttcggcgtaggcgtcggttttcggttttccttcgttcgtccttttaacgtttaaggtaggttccgtaccgtaggttcgtacggtaggtcgacgtacgtcggttggggtaggtacggttcggggtaggggggacggtcgggtcccggacccgacgtccgggtacgggtccccttccgtaggaccgtccttccgtccgtggtcgacgcggtccgttcggtaggtttaccttacccgttaccgttagtaaggttacgtactaggtcgactagtcgacctacggggttccggtacccacggtacgtccctacggaggaacgggacgggtcgtaagggtcgggtgggtacgacgttaagttaagtaggtagtaggtagtagggtaaggtaacgtagtaaactaaacttagtagtacgacgtaacgttacccggtaggtaagggacccggacctttactacccggtccttaccgaggaaacgactaaacgtacccaaacgaaacgaacctcgttagttacgtactacgtagaaaacttacgaccgtaaccncgtacgtaggagacccggaaggaaccgacccgtaagttagttacgttaaggtttaccttacgggaggaccgaacgggaaaggtaccggaaccaaccggtacccgtaacccgttaacggg

SEQ ID NO: 265021 - DNA, 536 bp, Homo sapiens
  misc_feature: GYAE6OF01D4I1K.34.26.C04.1.454.CMB.1.raw
  modified_base (308)..(308): a, c, t, g, unknown or other
  misc_feature (308)..(308): n is a, c, g, or t
  modified_base (458)..(458): a, c, t, g, unknown or other
  misc_feature (458)..(458): n is a, c, g, or t
  modified_base (530)..(530): a, c, t, g, unknown or other
  misc_feature (530)..(530): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacctccctgagacctctccgtgtgcagcgtcgtggacttcaccttcagtagtcatggcatgcacgtgggtcccncaggcctccgaggcaagtgggctggagtgggtggctagttatagtggtatgataggaagtgtacaatactatcgacagactcggtaggaacgggcctagttccaccgtctacagacgaacaactcccaaagaccgacgtctagtatctanactaaatcgaaccagacctgagacgcgaaggacacggtctatcgttactacgtgacggtgaagtagacacgngacccg

SEQ ID NO: 265022 - DNA, 528 bp, Homo sapiens
  misc_feature: GYAE6OF01CU78X.34.26.C04.1.454.CMB.1.raw
  modified_base (303)..(303): a, c, t, g, unknown or other
  misc_feature (303)..(303): n is a, c, g, or t
  modified_base (519)..(519): a, c, t, g, unknown or other
  misc_feature (519)..(519): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagctctggattcaccttcagtagtcatggcatgcacgtgggtcccnccaggcctccgaggcaaggggctgggagtggggtgctagtttatagtggtatgatggaagtagtacaattacatgacagtctcgtagaacggccgtatccgaccgtctacgaagagacaactacccaagaacacgtctgtatctagcaaatcgaccagcctagagacgaccggagacgacggactagtagttaactacgtgtgacgaggagagacncgacctacg

SEQ ID NO: 265023 - DNA, 567 bp, Homo sapiens
  misc_feature: GYAE6OF01EGR38.34.26.C04.1.454.CMB.1.raw
  modified_base (323)..(323): a, c, t, g, unknown or other
  misc_feature (323)..(323): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcggtggcccagccgtgggaccgtccctgacgtcctctcctgtgcagcgtctggacttccaccttcgagttacgtcagtggcagtcgactacgtcggggtcccnccgaggtcctaccgagggcgaaggggtctaggggagtggggtggctaggttatagtggtatgagtggtaagtgtacaatctatgcagtactcgtaggaggccgtatccgaccgtctacgagacgacaactccgaaagacncgtacttgactcgtagaaccaatccgacncgtccaggacgacgaccggaagaccgacgtactagtagttacttacngtacggacgagagacgactcgcctaacg

SEQ ID NO: 265024 - DNA, 585 bp, Homo sapiens
  misc_feature: GYAE6OF01B2J7N.34.26.C04.1.454.CMB.1.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggtggtttcgcgtaggctcttaagtaggtntcagtgtcaggtgcagctggtggagtgtgggggngcgtggccagcctgggactccngagctctccngtgctgccgtntggaattcacttnagtagcatggacntgcncgtcggcgcgcgcncgngacgaggngtggtggtggtggagtagtagtagtagtagtgtagtagtaagtagtataatactagtcgacgtacgtacgtacggtacggtacggacgtacgtaccgtaccgtacgtacgacgacgaactaactaaccgaacgaacgtaccgtacgtacgtacgtacgtacgtaacgtaacgtacgtacgacgacgacgacgacggaccggacggaccgtacgtacgtacgttagttacgttacgtacgtacggacggtacggacggacgacgacgacgtacg

SEQ ID NO: 265025 - DNA, 514 bp, Homo sapiens
  misc_feature: GYAE6OF01BTUCP.34.26.C04.1.454.CMB.1.raw
  modified_base (506)..(506): a, c, t, g, unknown or other
  misc_feature (506)..(506): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgcaggctccaggcaaggggctgggagtggggtgcagttatagtggtatgatggaagtgtacaatctatgcagactcgtgacggcgattcgacgtctcagagacaatacccaaagaccacgtctagtatctacgacaaagtcgaaccagcctaggacgacgaccgaggacacggtacgtagtagttattcgtgagcgagagagacncgactacg

SEQ ID NO: 265026 - DNA, 649 bp, Homo sapiens
  misc_feature: GYAE6OF01B7F4H.34.26.C04.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattccaccttcagtagtcatggcatgcacgtgggtccncgaggcctccgaggcaaggggctgggagtgggtgcagttanagtggtatgagtgggaagttagtctaaatactagtcgactaaggtacctaccggtaggaacggggtccgtaagtttcccgtaaccccggttcctacccggaaggtaacgaaccgtaaactaacccccgaaaaggaaccctacggtccttaggtaactcgtacgaaccaaacgtccgaacccgagtcccgtaggacgacggtacccggaaacgggacctaccgggtacgttaacgttacggttaacgtttacgtcgggtacggacccggaaggtaacgggaacgaccgtacgacccgtaacccgg

SEQ ID NO: 265027 - DNA, 547 bp, Homo sapiens
  misc_feature: GYAE6OF01CW6TN.34.26.C04.1.454.CMB.1.raw
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggattccaccttnagtagtcatggcatgcacgtgggtcccgccaggctccaggcaaggggctgggagtgggtgctagttanagtggtatgatggaagtagtcaaatactatgacagacctcggtgaaggccatcaccgtctcagagaacaatacccaaagaaccacgctgaactctgacaaatcgaaccagccgtagaggacgcccggaaggtaccgaccgggattaactaggttaattaccgtggtagaccggtaagaagaacggaacaggcccctaaacg

SEQ ID NO: 265028 - DNA, 575 bp, Homo sapiens
  misc_feature: GYAE6OF01EGZUW.34.26.C04.1.454.CMB.1.raw
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtggccccagcccgtgggaccgtccctgagacctctcctgtgcagcgtctggacttccaccttcagtgtcagtggcatgcacgtggggtcccnccaggcctaccgagggcaaggggctgggagtgggngcagtttanagtggtatggatgggaaagttagtacaaattactatgactagaccgtcggtaggaacgggccgtattccgaccgtctacgagaacacaactaccccaaagtaccacgtctagtactctgaacctaaagtccgaaccacgcctagacggacgaccgaggaccgacggacttagttagtaacgttcgtggtcgacggagaggacgacgcgaccctacg

SEQ ID NO: 265029 - DNA, 645 bp, Homo sapiens
  misc_feature: GYAE6OF01BP065.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgactctcctgtgcagcgtctggattccaccttcagtacgtcagtggcagtgcacgtcgggtcccgccagggcctccgaggcgaaggggtctgggaggtgggtggctaggttatagtggtatgagtgggaaagttagtactaaattactaagtcgactaacggtaccgttaccggtaggaaacgggtccgtaacgttccgtaacccgtcctaccgaaggaacgaacctaacgttaccccgaaacgaaccgtaccgtcttacgtactccgtacgaactaaacgtcgaacccgacgtacccgtaggacggaccggaccggaacggaaccgtacgggtacttacgttagttacgttacgttcggtacggacggtaaggacgaacgtaacgacgtacccgtaacgg

SEQ ID NO: 265030 - DNA, 172 bp, Homo sapiens
  misc_feature: GYAE6OF01ESKBW.34.26.C04.1.454.CMB.1.raw
  modified_base (170)..(172): a, c, t, g, unknown or other
  misc_feature (170)..(172): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgggctggcaaggcgcatagnnn

SEQ ID NO: 265031 - DNA, 549 bp, Homo sapiens
  misc_feature: GYAE6OF01E1S65.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccctgggaccgtccctgagactctcctgtgcagcgtctggattccacctttcagtagtcatggcatgcacgtgggtccgccaggcctccgagggcaaggggctgggagtggggtggcagttatatgggtatggagtgggaagtagtacaaatactatgacagtacctccgtaggaacgggccgtattccacccgtctaccgagacgacaactacccaaagaaccacgctgtactctagacaaagtcgaaccagcctagagacgccgaggacacggactagtagttattacgtgtcgacgtagagaagacacgccgtacg

SEQ ID NO: 265032 - DNA, 640 bp, Homo sapiens
  misc_feature: GYAE6OF01D2RDQ.34.26.C04.1.454.CMB.1.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (610)..(610): a, c, t, g, unknown or other
  misc_feature (610)..(610): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtcggcccagccgtgggacctccctgagactctcctgngcagcgtctggattccaccttcagtagtcatggcatgcacgtcgggtccnccgaggcctccgaggcaaggggctgggagtgggtgctagttatagtggtatggatgggaaagttgacaaattactatcggcaacggtacgtccggtaggaacggggccctaagtttcccgaacccgttcctacccgaacggtaacgaacctaaaccgttaccccgaaaacgaaacccgaaccggtccctttaggtaaccttaccgtacggaaacctaaacgttccggaaacccacggtcccgtagggaacgacgggacccgaagggtaaccaccgggtactagttagttaacttacgttcgngaacggagaacgacgaacacgccgtaaccg

SEQ ID NO: 265033 - DNA, 635 bp, Homo sapiens
  misc_feature: GYAE6OF01BNWIH.34.26.C04.1.454.CMB.1.raw
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcccgtgggaccgtccctgacgactctcctgtgcagcgtctggattcaccttcagtagtcagtggcatgcctacgtcgggtcccnccgaggcctccgagggcgaaggggctgggagtgggtggctaggtttatagtgggtatggaagtgggaaagttagtacctaaattaacgtagtcggactaacggaccttcccgggtaggaacggggtcctagttaccgaccccggttactacccggaaggtacgaacctaaacttaccccgaaaagtaaccacgtctaggttaactcgtagaacctaaagtcgaaccgagtcccgaggacgacggacccggaagggacccgaaggtctaagttggttaacttacgttacggtgaccggtaaggacgaaggaccacggccctacg

SEQ ID NO: 265034 - DNA, 598 bp, Homo sapiens
  misc_feature: GYAE6OF01DJ7CZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagaggtgtccagtgtcaggtgcagctggtggagtcgtgggggagcgtggcccagcctgggacgtccctgacgactctcctgtgcagcgtctggattcacctttcagtagtcatggcagtgcacgtcgggtccgccaggctccgaggcgaaggggctgggagtggggtgctagttatagtggtatggaatgggaagtgtacaaatactagtgacagtaccgtccgtaggaacgggccgtattcgaaccgttctaccgagaacgacaactacccaagaacacgcttagtactacgtgaactaactcgtaaccacgtacctaggacgacggaccggacggtaaccaacggtaccttaaggtagttaacgttacgtacggtacggtaaccggtaggtaaacggaaggtaaccgaacggcccgtaaccgg

SEQ ID NO: 265035 - DNA, 810 bp, Homo sapiens
  misc_feature: GYAE6OF01DLYT9.34.26.C04.1.454.CMB.1.raw
  modified_base (389)..(389): a, c, t, g, unknown or other
  misc_feature (389)..(389): n is a, c, g, or t
  modified_base (747)..(747): a, c, t, g, unknown or other
  misc_feature (747)..(747): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgcttacttttaagaggtgtccagtgtcaggtgcagcgtggtggagtcggtgggggagcgtcggcccagccgtgggaccgtccctggagtcctctccgtgtcgcgagtcgttctggtacttcctaaccttgaagttgtcagtggctagtcgcctacggtcgggtcccaccgaggccctacggacggcgaaggggtcgtgggacggtgggtacggctaaggtttanaggttaggtagtaggaaggtttagggaaattacgtaactaaaacgtttactaaggttcgaaccgtaacgggtaccgttcccgggtagggaaaccggggtcccttaacgttcccgtaacccggttcctaaccggaagtaacgtaaccctaaaccgtaacccccgaaaaagggtaacccgtaccggttacttacgttaaaccttacccggtaagtaaaccccgttaaaaccgttaccgggaaacccctacggggttacccgtaaagggaaccgggttaacccggaaccccggggtaaaacggggtaacccgacgggttttaaacccgttaagggtttaaccgtttaaccgtttaccgggnggtttaaccgggaagtaaccggggaacctaaaacggggcctaaaccggcccccgttaaacggg

SEQ ID NO: 265036 - DNA, 650 bp, Homo sapiens
  misc_feature: GYAE6OF01D7N8G.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttccgtcgttagctctttaagaggtgtccagtgtcaggtgcagctggtggagtctgggggagcgtggcccagcctgggacgtccctgagactctcctgtgcagcgtctggattccaccttcagtgtcatggcatgcactggggtccnccgaggctccgaggcaaggggctgggagtgggtgcagttatagtggtatgagtaggaaagttgtacaaatacctagtcgactaagtacctccggtagaaacgggtccgtaatttccgaacccgttctacccgaagacgtaaccgaactacccgaaagaaccgtaaccgtcgtagttaactcgtaagtaacctaaatccggtaacccaacggtacccgttaaggaacggtaccgggaacccggaacgggaacctaaccggggtacctttaaagtaggtttaaacgttaccctagggttacggaaccggtaagggtaaacgaccggaacgaaccggtccctaaaccggg

SEQ ID NO: 265037 - DNA, 949 bp, Homo sapiens
  misc_feature: GYAE6OF01DCU83.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtcggcccagccgtcgggaccgtccccgagacctctccgtgtgcagcgtcgtggactttccacctttcaagttacgtcagttggacagtcgacctaacggttccggggtcccgaccgacgggtcccttacccggacgggggtaccggaaagggggggtccttaggggggaaacgggttggggggtacggtaaccgttaagggttttaagttaacggtttaggggttaaagtttaggggaaagtttaccggggggtaaaaagttttaccggtaacctaaaaagtttaccgttaaggttaccggaccgttaaaccggtacccggttttacccggggtaaacggggtaaaccgggggtacccccggttaacccgttttacccccgggtaaaccccgggtttacccctttaacccggaaacggtaaaacccggtaaacccgtaaaaccccgttaacccccggaaaaacggtaaaccccgtaacccgggttaccgtttaacggtttaaccgttaccggtaacgtaaacccgtaaagttacccgggtaaacccgtacggtaccggttaacggaacgggtaaccccggaccggggaaacggaaccccggtaaacgggttaccttaaacggttaacggtttaaccgtttaaccggttacgggttacggaaccgggttaaacggaacgggaaaacggtacccgtaacccggtacccgtaaccggttaacccggggg

SEQ ID NO: 265038 - DNA, 517 bp, Homo sapiens
  misc_feature: GYAE6OF01A8UP6.34.26.C04.1.454.CMB.1.raw
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccaggctccgaggcaaggggctgggagtgggtggcagttatagtggtatgatggaagtagtacaatactatgcagactcgtagagggccgattcgaccgtctaccagacgacaactacccaagacacgctagtactcgtagacaaagtcgaaccagcctagacgacgccgaggacgacggctagtgtattcgngtgcgtagagagacngcctacg

SEQ ID NO: 265039 - DNA, 555 bp, Homo sapiens
  misc_feature: GYAE6OF01EK01Y.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctaggaccgtccctgagactctcctgtgcagcgtctggattccaccttcagtagtcatggcatgcacgtgggtcccgccgaggcctccgagggcaaggggctgggagtgggtgctaggttatagtggtatgagtggaaagtgtcaatactatgacagtactcgtagaacgggcgtattcgacgtctaccgagacaacgggaactaccgaacgaacacgctagtactctagacaaacgtacgaccacgaccgtagacgacggaccggacggaccgacggtacgtacgttagttacttacgtgtgacgagagagacgacgccgtacg

SEQ ID NO: 265040 - DNA, 546 bp, Homo sapiens
  misc_feature: GYAE6OF01CQE2S.34.26.C04.1.454.CMB.1.raw
  modified_base (257)..(257): a, c, t, g, unknown or other
  misc_feature (257)..(257): n is a, c, g, or t
tcagtacacgtgatcacgaccggtgctcgatttagtctagcgactttgggtttggggctgggagaggagcccagcactagagttcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggcccagcctgggaccgtccctgagctctcctgngcagcgtctggacttcaccttcagtagtcagtggcatgcacgtgggccaccgaggcctccgaggcgaaggggctgggagtggggtgctagttatagtggtatgagtaggaagtagtacaatactagtgactagacctccggtagaacgggccgtattccgacccgtctaccgaagacgacaactacccgaagaaccacgctatactcgtagacaagtcgaccacgctagagacgccgaggaccaggacgtagtgtacttacgtgtggacgaagacgagacagccgtacg

SEQ ID NO: 265041 - DNA, 546 bp, Homo sapiens
  misc_feature: GYAE6OF01A1R45.34.26.C04.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattccaccttcagtagtcatggcatgcacgtgggtccnccaggctccgaggcaaggggctgggagtgggtgctagttanagtggtatgatggaagtagtacaaatacgtatgactagactccggtagaacgggccgtagttccgacccgtctaccgaagacgaacaactacccaagaacacgtctagtactctagacaaacgtcgaaccagcctaggacgacggaccggaggaccacggtctagtagttacttacgtgtagacgagagaagacagccctacg

SEQ ID NO: 265042 - DNA, 738 bp, Homo sapiens
  misc_feature: GYAE6OF01BZ6TB.34.26.C04.1.454.CMB.1.raw
  modified_base (178)..(178): a, c, t, g, unknown or other
  misc_feature (178)..(178): n is a, c, g, or t
  modified_base (287)..(287): a, c, t, g, unknown or other
  misc_feature (287)..(287): n is a, c, g, or t
  modified_base (650)..(650): a, c, t, g, unknown or other
  misc_feature (650)..(650): n is a, c, g, or t
tcagtacacgtgatcacgaccggtgctcgatttagtctagcgactttgggttggggctgggagaggagcccagcactagaggtcggcggtgtttccattcggtgatcagcactgaacacagaggactcaccatggagtttgggctgagctgggttttcctcgttgcttcgttttaagnggtgtccagtgtcaggtgcagcgtgggtggagtcgtgggggagcgtggcccagccgtgggacgtccctagagaccttctccgtgtcgcagcgtcgtgtacttcaccttnaggtatcatggactagtcgacctcggtcgggtcccaccgacggtcctacccggaagggaccgggaaacggggggtctgggggtaacggggttgggggtacggaaccgttaagggtttaagttaagggtacgggttaagtagggtaacgttaggggtaaaaagtttacgtaaacctaaagttaaccgttaagtacggacctaacgggtaacccgttaccgggtaagggtaaaccgggtccgtaaaccgtttcccgaaaccccggttcctaacccggaagtaaaccgtaaccgaaccgttaacccgaaaggtaacccacgtacgttagtaacctgtacgaacgtaaactccggaacaccgtacgngaacggcgacggaacggtacgtacggtacttaagtaggtacgtttacgaggttacgaggtaacgaagtacgaacaccgtccgtaacgg

SEQ ID NO: 265043 - DNA, 529 bp, Homo sapiens
  misc_feature: GYAE6OF01BRV7Z.34.26.C04.1.454.CMB.1.raw
  modified_base (521)..(521): a, c, t, g, unknown or other
  misc_feature (521)..(521): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacctccctgagctctcctgtgcagcgtctggattcaccttcagtagtcatggcatgcacgtgggtcccgccaggcctccgaggcgaaggggctgggagtgggtggcagttatagtggtatgagtggaagtagtacaatactatgacagacgtcgtgaacgggccgattcgaccgtctccagacgacaactacccaagaacacgctgtatctagacaaacgtcgaaccagcctagacgacgaccggagacgacggctacgtgtacttcgtagtgacgagagagacngcctaacg

SEQ ID NO: 265044 - DNA, 615 bp, Homo sapiens
  misc_feature: GYAE6OF01C2I8Y.34.26.C04.1.454.CMB.1.raw
  modified_base (305)..(305): a, c, t, g, unknown or other
  misc_feature (305)..(305): n is a, c, g, or t
  modified_base (606)..(606): a, c, t, g, unknown or other
  misc_feature (606)..(606): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacgtccctgagactctcctgtgcagcgtctggacttcaccttcagtagtcagtgcatgcacgtgggtccncaggctccgaggcaaggggctgggagtggggtgctagttatagtggtatggagtagggaacgttagtacaaagttaactagtgacaagtaccgtaccggtaggaaacggggtcccgtaactttacccaaccccggttctaccccgaaggaaccgaaccgaaacttaacccccgaaagaaacctaccgtaccttagtattactacggaactaaaacgtccgaacccacgcccgtaggacgaacggacccggaaggaccgacggtacttaagtgttattacgtggtgacgtaagagacgaacncgcctaacg

SEQ ID NO: 265045 - DNA, 672 bp, Homo sapiens
  misc_feature: GYAE6OF01BRXRX.34.26.C04.1.454.CMB.1.raw
  modified_base (629)..(629): a, c, t, g, unknown or other
  misc_feature (629)..(629): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcctcgttgctcttttaagaggtgtccagtgtcaggtgcagctggtggagtcgtgggggagcgtgcccgagccgtgggacgtcctgagtactctcctgcgcagcgtcgtggacttccaccttcagtagtcaagtggcagtggctacgtcggggtcccaccgagggcctacccgagggaccgaaagggggtcctggggtaaggtgggggttcggacgtaaggttttataaggttgggttaactggtaagttaggggaaacttaaggtactaaattaacttggtacgacgtagtacccgttccggtaggaacgggcctagttccgtacccggtactaccgaagaacgacctaaacctacccgaaaacggtaacctacggtattacgtacctagaaccgaactaacgtaccgaaccgcgtaccgagaccggaaccggaccggacgaacgaccgttagtacgttagttacgttacgnggtaacggcgtaaggaacgtaacgaccgtcggaacccgtacgg

SEQ ID NO: 265046 - DNA, 561 bp, Homo sapiens
  misc_feature: GYAE6OF01CKWF1.34.26.C04.1.454.CMB.1.raw
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
  modified_base (529)..(529): a, c, t, g, unknown or other
  misc_feature (529)..(529): n is a, c, g, or t
  modified_base (551)..(551): a, c, t, g, unknown or other
  misc_feature (551)..(551): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctacttttaagaggtgtccagtgtcaggtgcagcgtggtggagtcgtgggggagcgtggcccagcctgggacgtcctgagactctcctgtcgcagcgtctggacttcaccttnagtagtcagtggcatgccacgtcgggtccnccaggcctcgaggcgaaggggctgggagtgggngctagtttanagtggtatgatagggaactagtacaaatacgtaanggacacggtactcggtaggaacgggccgtattccgaacccgtctaccgaagaacgaacaacgtaccaaagaacacgctagtatctgaactaatacgacctaagcctaggacgacgaccgtaggacacggctagtgtaattcgnggtagacggaagacggacgaanaccgccaccg

SEQ ID NO: 265047 - DNA, 564 bp, Homo sapiens
  misc_feature: GYAE6OF01C8VZK.34.26.C04.1.454.CMB.1.raw
  modified_base (253)..(253): a, c, t, g, unknown or other
  misc_feature (253)..(253): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggcctgggactccctgagactctccngtgcagcgtctggattcaccttcagtagtcatggcatgcacgtgggtccgccaggcctccaggcaaggggctgggagtggggtggcagttatagtggtangatggaagtagtacaaatactatgacagacctccggtaggaacgggccgtaagttccacccgtctaccaaggacgtaaccaacgtaacccaaagaacaccgtactaggtaactcgtacgactaaagtacgaaccacggtccctaggacggacgaccggagtaccgacggctaagtagttatactggtgacggtagacgagacagccctacg

SEQ ID NO: 265048 - DNA, 581 bp, Homo sapiens
  misc_feature: GYAE6OF01A39L1.34.26.C04.1.454.CMB.1.raw
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (564)..(564): a, c, t, g, unknown or other
  misc_feature (564)..(564): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggcccagccgtgggacctccctgacgtacctctcctgtgcagcgtctggattccaccttcagtagtcatggcatgcacgtgggtccgcgaggcctcgaggcgagggctagggaggtgggtgacgtagttatgtagtagtgagtagggaagtacgtaacgaattactagtgacagtaccgtcggtaggacggctactccgaccgtctacgaagacgacacgtaaccgaagaaccgngtacgttagtactcgacgaactaacgtacgaccncgtacgaggacgaccggacggaacggacgacgtacgtagtcgttaacgttcgtgacggacgtaaggaacganaccgacgacccgtacgg

SEQ ID NO: 265049 - DNA, 622 bp, Homo sapiens
  misc_feature: GYAE6OF01CGOXF.34.26.C04.1.454.CMB.1.raw
  modified_base (168)..(168): a, c, t, g, unknown or other
  misc_feature (168)..(168): n is a, c, g, or t
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
  modified_base (606)..(606): a, c, t, g, unknown or other
  misc_feature (606)..(606): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctnttttaagaggtgtccagtgtcaggtgcagcgtgggtggagtcgtgggggagcgtcggcccaggccgtgggaccgttccctggacgaccttcctccgtgtcgcgaggccggttccggatttccgacctttcagtacgtcatggcatcgcacgtcgggtcccncaggcctccgagggtccgaagggggctagggacgtggggtagctaaggtttanagttgggtaatggaagtacgggaattagtactaaattactagtgacagtaccgtccgtaggaacgggcctacttccgaccgtctaccgaagaacgactaacacccgaaagaaccacgtcgtagtactaccgtagaacctaaatccggaacctacggacctaggaacggacggacccggaagaccgacgtactaagtcgttattacgttggacgagaacgacganaccacgcccgagtcgg

SEQ ID NO: 265050 - DNA, 604 bp, Homo sapiens
  misc_feature: GYAE6OF01CY89E.34.26.C04.1.454.CMB.1.raw
  modified_base (305)..(305): a, c, t, g, unknown or other
  misc_feature (305)..(305): n is a, c, g, or t
  modified_base (591)..(591): a, c, t, g, unknown or other
  misc_feature (591)..(591): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgccagcgtctggacttcaccttcagtagtcatggcatcgcacgtgggtccnccgaggctccgaggcgaaggggctggaggtggggtgcgtaagttatagtggttatgtagtaggaagtagtcaattactatgacagacctcggtaggaacgggtccacgttccgaacccgttctaccgaaggacgaaccaactaacccaaacgaactaccggaccttaggtaacttcgtacgactaaagtacgtaccacgaccgtgacggacggaccggaacggacgtaaccggtcttaagtagttaacgtttacgtaggttggacgtaacggaacgtacgaaccgngccctaaaccggg

SEQ ID NO: 265051 - DNA, 622 bp, Homo sapiens
  misc_feature: GYAE6OF01BQOCW.34.26.C04.1.454.CMB.1.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgctctcctgtgcagcgtctggattcaccttnagtagtcatggcatgcacgtgggtccnccgaggctccgagggccgaaggggcctgggagtgggtggctaggttatagtggtatggataggaagtagtacaaattactatggactaagcctcggtaggaacgggtccgtattaccgacccgtctaccgaagaacgaacctaactaccccgaaagaaccaccgtcttacgtactacgtacgactaaacgtcgaacccacgtacccgtaggacggaccggtccggaaacgggtaccgaccgggtacgtaacgttacgttaacgtttccggtaggtcggaacggtacggaacgggaacgaacgaccggtccctaaacccgg

SEQ ID NO: 265052 - DNA, 581 bp, Homo sapiens
  misc_feature: GYAE6OF01D6CBZ.34.26.C04.1.454.CMB.1.raw
  modified_base (181)..(181): a, c, t, g, unknown or other
  misc_feature (181)..(181): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
tcagtacacgtgatcacgaccggtgctcgatttagtctagcgactttgggtttggggctgggagaggagcccagtactagaggtcggcggtgtttccattcggtgatcagcactgaacacagaggactcaccatggagtttgggctgagctgggttttcctcgttgctcttttaagaggtntccagtgtcaggtgcagctggtggagtcgtgggggagcgtggcccagccgtgggacctccctgacgctctcctgtgcagcgtctggattcaccttnagtagtcagtggcatcgccacgtcggggtcccnccagggcctcccgaaggggccgaaaggggggcttaggggacggtggggtcggacctagttagtagtggtaatgaagtggaagtgtacaatctangcagtctcggtagacggcctatccaccgtctaccagagacaactacccaaagaccacgctagtactcganacaagtcgaccagtcctagaacgacgaccggaaggaccctacggtacttacgttgttaacgttacgtggtacggacgaaggaggacgaacgacggccctaagtcggg

SEQ ID NO: 265053 - DNA, 770 bp, Homo sapiens
  misc_feature: GYAE6OF01EL0GM.34.26.C04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (324)..(324): a, c, t, g, unknown or other
  misc_feature (324)..(324): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagnggtgtccagtgtcaggtgcagctggtggagtcgtgggggagcgtggcccagcccgtgggaccgtccctgacgacctctccgtgtcgcagcgttctggactttccgacctttcaggttagcagtggcatcgctacgtcggggtacccnccgaggcctccgagggaccgaaggggtctagggaggtgggtggactagttatagtagggtactaggagtagggtaaagttagtactaaaagttaccgtagtacgacctaaagggtacccgttaccgggttaagggaaaccggggtcctaacgtttacccgaacccgtttcctacccgaaaggtacgtaacctaaacccgtaaccccgaaaacgaaaccgaccggtacttacggttaactacggtaacgtaaaccgtaaaacgtccggtaaacccgtacggtaccccgtaagggaaaccgggaccgggaaccccgggaaacgggtaaccccggtaaaccgggttactttaaacggtttaccgggtttaaactttaccgggtagggttaccggaaccgggttaaggaaacggtaaaccggaccgttaaccgggaccccttaaaccggg

SEQ ID NO: 265054 - DNA, 742 bp, Homo sapiens
  misc_feature: GYAE6OF01DM6RN.34.26.C04.1.454.CMB.1.raw
  modified_base (361)..(361): a, c, t, g, unknown or other
  misc_feature (361)..(361): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggtttttcctcgttgcttcttttaagaggtgtccagtgtcgaggtgcagtcgtgggtggtaggtcggtgggggaggccggtcggacccgaggccgtcggggaccgtcccgtagacgtacctcctccgtgtcgcacgtcgttcgtggtacttccacctttacgagttacgtcagttcggactagttcgaccgtacggtccggggtcccnccggaggcccttaccggagggacggaaggggtccgtaggggtacggtcggggtgtacgtaaggtttaataggtgggttaagaggtacggtaagggtaaacgtttacggtaactaaaacgtttacgtaagttacggaacgtaccggtaccgtaccgggtaaggggaaaccgggtcccgtaacgttaccccgtaccgtacccgtaaccggtaacggaaacgaaacccgtaacctaacccgaaacgaaccgtaacgtcgtaacgtacgtctaacgaactaacgtaccgtaaccgtacgccgtagaccgtacggaccggtagaccgaacgtacgttacgtagtacgttagcgtagacggtacgacgtacgacgtacgcgtaccgg

SEQ ID NO: 265055 - DNA, 715 bp, Homo sapiens
  misc_feature: GYAE6OF01EMRHV.34.26.C04.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagactgggtttttcctcgttgcttacttttaagaggtgtccagtgtcaggtncagctggtgagtcgtggggagcgtggccagcctgggacctccctgacgctctcgtggtgcgagcgtctggtacttccaccttcaagttgtcagtcggnagtgacgtacgttcggggtccaccgacggcctaccgagggtaccgaacggggtcgtaggtacggtggggtcgactaaggttaagtaggttggtaactggaacgttagggtaaacgtacgtaacgtaaagttacgtagtcggacgtaacggtaccgttaccggagggaaccgggtaccgtacgttacccgaccggttccaccggtaaagaccgtaacctaaaccgtaccctaaaacggacctaccgtacgtttagtaaccgttcgaacgtaacgtaaacgtccgaaccgtacggtaccgtagggaaccgacgggtacccggaaacgggaccgtaacggttacgttaacgtaggtttaacttacccggtgggtaaccgacggtaaaggtaaccgaagtaacccgtacgtaccccgtaacg

SEQ ID NO: 265056 - DNA, 576 bp, Homo sapiens
  misc_feature: GYAE6OF01D3IV2.34.26.C04.1.454.CMB.1.raw
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
  modified_base (542)..(542): a, c, t, g, unknown or other
  misc_feature (542)..(542): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagaggtgtccagtgtcaggtgcagctggtggagtcgtgggggagcgtggcccagcctgggacctccctgagctctcctgtgcagcgtctggacttccaccttcagtagtcatggcatgctacgtgggtcccncgaggcctccgaggcaaggggctagggaggtgggtgctagttanagtggtatgatggaaagtgtacaaatactagtgacaacggtactccggtagaacgggcctattccgacccgtctacgagaacgaactaactacccaaagaaccacgtctagtactacgtgaacaaacgtcgaacctagccctaggacgacgaccggacgtacaccggtacttaagttagttaacttcgngtacggacgtaaggacgacgaccacgccctaacg

SEQ ID NO: 265057 - DNA, 665 bp, Homo sapiens
  misc_feature: GYAE6OF01C5A6M.34.26.C04.1.454.CMB.1.raw
  modified_base (321)..(321): a, c, t, g, unknown or other
  misc_feature (321)..(321): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagtcgttgggttttccctcgttgcttacttttaaaggaggtgtccagtgtcgaggtgcagctgggtggagtcgtgggggagcgtcggcccaggccgtgggacctccctgagcctctcctgtcgcagcttctggattccaccttcgagtagtcagtggcatgcacgtcgggtcccnctaggcctccgaggcgaaggggctgggaggtggggtgcgtagtttatagttggtaatcggaagtaggaacgtagtacaaagttactagtgacagtaccgtccggtaggaacgggaccgtacttaccgaccccggttacaccgaagacgaaccaaccgtaaccccaaaaggtaaccacgtacctagtacttcgaacgaactaaatccggaacctacgacccgtaggaacggacggtaacccgggaggaaacccggtacggtaaccgtttagttacgtttaacgtttaacggtcgggttacggaccggtaaaggaacgggaataacccgacggtaccccgtaacgg

SEQ ID NO: 265058 - DNA, 551 bp, Homo sapiens
  misc_feature: GYAE6OF01CKK58.34.26.C04.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgacgctctcctgtgcagcgtctggattccaccttcagtagtcatggcagtcgcacgtcgggtcccncgaggcctaccgaggcgaaggggctgggaggtgggngcagtttanagtggtatgatggaaatgtacaattactagtgacagacctcggtagaacgggccattccgaccgttctaccaagacgtaacaactacccaaagaaccacgtctatacgtctagactaagtcgaccagacctaggacgacgccggacgaccgacgaccgtatacgttattacgtgtcgacgtagagagacacgccgacg

SEQ ID NO: 265059 - DNA, 704 bp, Homo sapiens
  misc_feature: GYAE6OF01A2O4S.34.26.C04.1.454.CMB.1.raw
  modified_base (161)..(161): a, c, t, g, unknown or other
  misc_feature (161)..(161): n is a, c, g, or t
  modified_base (316)..(316): a, c, t, g, unknown or other
  misc_feature (316)..(316): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgcttcttttaagaggtgtccagtgtcaggtgcagcgtggtggagtcgtgggggagcgtggcccagccgtgggacctccctgacgcctctcctgtcgcagcgtctggacttccacttcagtagtcagtcggctatcgctacgtcgggtcccnccgacggctccgagggcgaaggggtctagggagtggggtgactaggttatggtaggtataggacgtagggaaagttacgtactaaagttactagtgaccgaaggtacccgttccgggtaagggaaccgggtccgttacgttcccgacccgttactaccgaaagaaccgaactaacctacccgaaacgtaaccaccggtacttacgtacgtacgtacgtaacctaaacgtccgaaacccgtcgtaccgtaggaacggtaaccggacccggtaaacgggaccgtaaccggggttacctttaagtttacgggtttaaaccgtttacggtacgggtaccggaacggtaaacggtaacggaaaccgaccgtaacccggtaccccgtaaacggg

SEQ ID NO: 265060 - DNA, 619 bp, Homo sapiens
  misc_feature: GYAE6OF01BQ9TO.34.26.C04.1.454.CMB.1.raw
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagaggtgtccagtgtcaggtgcagctggtggagtcgtgggggagcgtggcccagccgtgggacctccctgagctctcctgtgcagcgtccggattccaccttcagttagtcagtggcatgccacgtgggtcccnccgagggtcctaccgaggcgaaggggtctagggagtgggtgctagttatgtggtatgataggaagtatcaattactatcgacgtaagtacgttccgtaggaacgggccgtaacgttccgtaccgtctaccgaagtaacgaacctaacgtacccaaagaaccgtacgtactagttactcgtacgaacaacgtagaacctacgaccgtagacgtacggccggacggaaccgtacggacgtacgttacgttaattacggtcgtacggacgaacggtacggacgaaccgtaccggtaccgaaccgtaccggg

SEQ ID NO: 265061 - DNA, 587 bp, Homo sapiens
  misc_feature: GYAE6OF01CDFLL.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgagctctcctgtgcagcgtctggacttccaccttcagtagtcagtggcatgcacgtgggtcccncaggcctccgaggcgaaggggctgggagtgggtgctagttatagtggtatggatgggaaagttgtacaaagttactagtcgacacggtaccgtccggtaggaacgggtccgtaattccgacccgtcctaccgaagaacgaaccaactacccaaagaaccacgtactagtactctagaactaagtcgaccacgccgtagacgacgaccggaaggaccgacggtacgttacgttagttaacttacgtggtagacggaagacggaacgacgtacgccgtacg

SEQ ID NO: 265062 - DNA, 521 bp, Homo sapiens
  misc_feature: GYAE6OF01A42PV.34.26.C04.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtcccnccaggcctccgaggcaaggggctgggagtggggtgctagttanagtggtatgatggaagtagtcaaatactatgcagactcgtagaggcgatcaccgtctaccagacgacaactacccaagaaccacgctagtatctagacaaagtcgaaccagcctagacgacgccgaggaccacggctaagtgtacttacgtgtgacgtagagagacagccgtacg

SEQ ID NO: 265063 - DNA, 613 bp, Homo sapiens
  misc_feature: GYAE6OF01DHUDG.34.26.C04.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggcccagccgtgggacgtccctgacgctctcctgtgcagcgtctggattccaccttnagtagtcatggcatgcacgtcgggtcccnccgaggcctaccgaggccgaagggggtctagggaggtgggtcggactaggtttatagtgggttatggtaagtagggaaagttagtacaaattaccgtagtcgactaagtaccgtaccggtaggaaacgggtccgtagttccgacccgttcctaccgaagaacgaacctaactacccgaaagaactacgtcttagtacgtctagaactaagtcgaaccacgtccgtaggacggaacgccggtaaggaccgacggtacttagtagttaattccgtagtaggacgtaggacgacgacgacgccgtacg

SEQ ID NO: 265064 - DNA, 574 bp, Homo sapiens
  misc_feature: GYAE6OF01D3P5B.34.26.C04.1.454.CMB.1.raw
  modified_base (278)..(278): a, c, t, g, unknown or other
  misc_feature (278)..(278): n is a, c, g, or t
  modified_base (381)..(381): a, c, t, g, unknown or other
  misc_feature (381)..(381): n is a, c, g, or t
  modified_base (563)..(563): a, c, t, g, unknown or other
  misc_feature (563)..(563): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagcctgggacgtccctgagactctcctgtgcagcgtctggattccaccttnagtagtcatggcatgcacgtgggtcccgcaggcctccgaggcgaaggggctgggagtggggtgctagttatagtggtatggataggaagtgtacaaatactanggactaagactccggtagaacgggtcctattccgacccgtctaccgaagacgaaccaactacccgaaagaaccacgtctagtactcgtagaaccaaagtcgaacctacgcctaggacgaacggccggaaggaccacggtattacgttagttaacttcgtggtacgacggagaaggacgaacncgacccgtacg

SEQ ID NO: 265065 - DNA, 574 bp, Homo sapiens
  misc_feature: GYAE6OF01CBJHP.34.26.C04.1.454.CMB.1.raw
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctccgtgtgcagcgtctaggattcaccttcagtagtcatggcatgcacgtgggtcccncgaggcctccgaggcgaaggggctgggagtggggtgctagttatagtggtatgatggaatagtnaatacatgacagtctcgagacggcattcaccgtctaccagacgacaactacccaaagaaccacgtactagttaactactacgaactaaagtcgaaaccacgtaccgtaggaacgacggaccggtaacgggaaccacgggtactacgttaggttaattaccggttagtacggacggtaaggaacgagaccgacgcccgtaaccgg

SEQ ID NO: 265066 - DNA, 765 bp, Homo sapiens
  misc_feature: GYAE6OF01DP8HJ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcggtgcccagcccgtggggaccgtccctgacgtacctctcctggtcgcagccgttctaggtactttccacctttcaaggtagtccaagtggactagttcgacctacggtcggggtcccgccgtacgggccctaccggagggccgaaaggggggtccttaggggtagggttgggggtcggacctaaggttttataaggttagggtaatgggtaacgtttaggggaaaagtttacggtacctaaaagttaacgttagttaggaccgtaacggtacccgttccgggttaagggaaccggggtaccctagttacccgtaccccgttccgtaacccgaagtaacgaacctaaccgtaacccccgaaagaaaccgtaccgacgtttacggtaacgtcctaacggaacctaaacggtaccggaacccacggtacccgtagggaaccggtaacggaaccccggtaaagggacccgtaccggttacttaaggttacgtttatttacgtcggttaggaccggtaaggaacggaagaaccctagacccgtaaccgg

SEQ ID NO: 265067 - DNA, 729 bp, Homo sapiens
  misc_feature: GYAE6OF01CLB49.34.26.C04.1.454.CMB.1.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
  modified_base (688)..(688): a, c, t, g, unknown or other
  misc_feature (688)..(688): n is a, c, g, or t
tcagtacacgtgatcacgaccggtgctcgatttagtctagcgactttgggtttgggggctgggagaggaagcccagcactaagaggtcggcggtgtttccattcggtgatcagcacttggaacacagaggactcaccatggagtttgggctgaagctgggttttcctcgttgctcttttaagaggtgtcctagtgtcaggtgcagactggtgagtcgtgggggagcgtggcccgagcctgggacgtccctggagactcgtcctagtgcagcgtctagtatcaccttnagtatcatcgctatcgcacgtgggtcccnccgtacggcctccgaggccgaaagggggtcctagggacgtggggtcggctaaggtttaatacgtaggtagttggaagttacgggtaaagtttacgtacccgtaaataaccgtttaagtacggaaccgtaacgggtaacccgtacccgggttaagggaaaccggggtaccccgttaacgtttcccgaaccccgggttacctacccgtaaaaggtaaacgtaaccgtaaaaccgttaccccaaaaaggtaacccctaacgggtacctttaaggttaacttaccgttacgaaacttaacgtcgaacccgtacggtacccagggaacgacggaccgaacgggacgaaccgggtattaacgttagttaacgtttcgnggtacgtacgaacgtacgaacggtaccaggtccctaaccgg

SEQ ID NO: 265068 - DNA, 610 bp, Homo sapiens
  misc_feature: GYAE6OF01BSKSG.34.26.C04.1.454.CMB.1.raw
  modified_base (504)..(504): a, c, t, g, unknown or other
  misc_feature (504)..(504): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtggtggagtcgtggggggagcgtggcccaggccctggggacctcccgtgacgacctctcctgtgcagcgtctggattcaccttcagtagtcagtggcagtgcacgtcgggtcccgccagggcctccgagggccgaaggggctgggagtgggtagctagttatagtggtatggagtgggaaattagtacctaaatactagtcgcgtaagtaccgtccggtaggaacgggtcctaatttaccgaacccgtctaccgaagaacgaacctaaacgtacccaaagtaaccaccgtctagtactcgtanaaccaaagcgaaccagtcctaggaacgcggaaccggagaccgaacggtcctaagttgtaacgtttctgtaacggacgtaaggaacggaagaccacggccctaacgg

SEQ ID NO: 265069 - DNA, 653 bp, Homo sapiens
  misc_feature: GYAE6OF01CTGMC.34.26.C04.1.454.CMB.1.raw
  modified_base (601)..(601): a, c, t, g, unknown or other
  misc_feature (601)..(601): n is a, c, g, or t
  modified_base (643)..(643): a, c, t, g, unknown or other
  misc_feature (643)..(643): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaaagaggtgtccagtgtcaggtgcagcgtggtggagtcgtgggggacgcgtggcccgagccgtgggaccgtccctgacgtactcctccgtgtcgcaggtcgttcgtggtacttccaccttcgaagtacgtcaagttggactagtcgacgtacgttcggggtcccaccgaggccctacccggagggccggaaaggggtcgtagggacggttggggtggtacttaaggttactagtgggtagtagtacggttaggtaaagtcgtaactaagttactagtcgactacggtaccgtaccggtagggaaccgggtcctaagtccgtaacccgtcctaacgaagacccgaactaaaccgtacccaaagacctcgtacgtataactctaacgactaaagtccgacacgctaggacgacgacggagaccgtaggnttacgtagttactacggtgtacgaggtaacgacgacggtacncgtccgaacg

SEQ ID NO: 265070 - DNA, 583 bp, Homo sapiens
  misc_feature: GYAE6OF01CZ1FE.34.26.C04.1.454.CMB.1.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
  modified_base (568)..(568): a, c, t, g, unknown or other
  misc_feature (568)..(568): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggcccagccgtgggacgtccctgacgctctcctgtgcagcgtctggtacttcaccttnagtatcagtggcatgcacgtgggtccncgagcctcgaggcgaagggctggaggtgggtgcagttnatggtangataggaagtgacaagttactagtgacagtacctcggtaggaacgggtctaacttccacccgttctaccgaagaacaaccgaactaccgaaacgaacacgacgtntactctagaactaaatcgaaccncgacctagacgacggaccggaaaggaccgaacggtctaagttagttaacgttaacgtggtacggacggtaaggaaacgaggaaccncggtaccgtaaccgg

SEQ ID NO: 265071 - DNA, 982 bp, Homo sapiens
  misc_feature: GYAE6OF01AWSH9.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcggtggggggagcgtcgcccaggccgtggggacctcccgtggacgtaccttcctccgtggtcgccgtacggccgttacgtcgggtaacttttcccgaacccgttttcgaagggttaacgttccaaggttcggggacctagttcggaccgtaccggtttcggggggtcccccaaccggtacgggtcccttacccgggaaggggtccggtaaacgggggggtcttaggggggaacgggttcggggggtacgaaccggttaaggttttaaacgtaggttggggtaataggaaggttacggggtaaaacgttacggtaactaaaagtttaccgtaggttaccggacgtacgggtaaccggttcccgggtaacgggtaaaccgggggtacccgttaaccgtttacccccggtaaccccggttaccgtaaccccgggaaacggtaaaccggtaaaccccgttaaaacccggtaacccccgaaaaaacgggtaaacccccgtaaccgggtttaccctttaacggttaaccgttttacccggaaacggttaaacccgttaaaacggtacccggtaaacccccgtaacgggttaccccgggttaagggaacccgggtacccgggaaccccggggtaaacgggaacccgggtaaaacccggttcgtttaaaccgggtttaggtttaaacccggtttaacccggttaggggtaacccgggtaaccgggtaaacgggaaaccgggaaacggacccccgttaaacgggacccccttaaccgggg

SEQ ID NO: 265072 - DNA, 669 bp, Homo sapiens
  misc_feature: GYAE6OF01C9KCT.34.26.C04.1.454.CMB.1.raw
tcagtacacgtgatcacgaccggtgctcgatttagtctagcgactttgggtttggggctgggagaggagcccagcactagaggtcggcggttgtttccattcggtgatcagcactgaacacagaggactcaccatggagtttgggctgagtcttgggtttttcctcgttgcttcttttaagaggtgtccagtgtcaggtgcagcgtggtggagtcgtgggggagcgtggcccagcccgtgggacctccctagacgtacctctcctgtcgcaggcgtctggacttccacttcagtacgtcagtcggactatcgctacgtcggggtcccgaccgtagggtcctaccggagggtaccaagggggtctaggggacgtggggtgtactaaggtttataggttgggtaatagaagttacggtaaagttacgataaagtactagtcgacgtacggtacgtcggaggtaacggcgtacttacgtacccgtacacgtagaacaacgtacctaacccgaaagtaccgacgtacgttacgtactccgtaacgaactaaacgtccgaaccgtaccgtacctaggaacgaccggtaccggaaacggtaccgtacggtactaaggttacgttaagttccggagtacggaacgaagtaacggaacgaccaccgtccgtaaccgg

SEQ ID NO: 265073 - DNA, 580 bp, Homo sapiens
  misc_feature: GYAE6OF01COSUW.34.26.C04.1.454.CMB.1.raw
  modified_base (309)..(309): a, c, t, g, unknown or other
  misc_feature (309)..(309): n is a, c, g, or t
  modified_base (564)..(564): a, c, t, g, unknown or other
  misc_feature (564)..(564): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagaggtgtccagtgtcaggtgcagctggtggagtcgtggggggagcgtggcccagcctgggactccctgagctctctgtcgcagcgtctggacttcaccttcagtagtcatggctatgcacgtcgggtcccncgaggcctccgaggcgaaggggctgggaggtgggtgactagttatagtggtatgagtaggaagtagtacaattactatgacagtaccgtcggtaggaacgggtccgtacttaccgacccgttctaccgaagacgaactaaaccacccgaaagaaccgactcgtacgtactctacgaacaagtacgaccagccgtagacgacgcggacggacgtacggactacgtagttacttacgcgtagacggtaggaacgganaaccgcgacccgtacg

SEQ ID NO: 265074 - DNA, 553 bp, Homo sapiens
  misc_feature: GYAE6OF01B0QR7.34.26.C04.1.454.CMB.1.raw
  modified_base (312)..(312): a, c, t, g, unknown or other
  misc_feature (312)..(312): n is a, c, g, or t
  modified_base (548)..(548): a, c, t, g, unknown or other
  misc_feature (548)..(548): n is a, c, g, or t
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagctgggtttttctcgttgcttcttttaagaggtgtccagtgtcaggtgcagctggtggagtcgtgggggagcgtggcccagccctgggacgtccctgacgtctctcctgtgcagcgtctggacttcaccttcagtacgtcatggcatgcacgtcggggtcccnccaggcctccgaggcaagtgggctgggagtgggtgctagttatagtggtatgacgtggaagtagtacaaatactatgacagtaccgtcggtaggaacgggtccgtattcccgaccgtctaccgaaggacaacaacctaccgaaagaaccacgtactagtactcgacgtacaaagtcgaaccagcagacgacgacgacgacgacgtctatcgttactcgtgacgacgagagacgacnggacc

SEQ ID NO: 265075 - DNA, 614 bp, Homo sapiens
  misc_feature: GYAE6OF01AXS6D.34.26.C04.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (478)..(478): a, c, t, g, unknown or other
  misc_feature (478)..(478): n is a, c, g, or t
tcagtacacgtgatcacgaccggtgctcgatttagtctagcgactttggggtttgggggctgggagaggagcccagcactagaggtcggcggtgtttccattcggtgatcagcactgaacacaggaggactcaccatggagtttgggctgagctgggttttcctgttgctcttttaagaggtgtccagtgtcaggtncagctggtggagtcgtgggggagcgtggcccagcctgggactcctgagactctccgtgtgcagcgtctggattcacttnagtagcagtggcatcgcacgtcgggccncaggcctccgaggcgaaggggctggggaggtggggtgactaggtttatagtagggtatggaagtagggaagttagtacaaagttactagtggactaacggtaccgttccggtaggaacgggtcctaattccgaccgtctaccgaagacgaacctaaacgtacccgaaacgaacncgtctacgtacttcgtagaactaaacgtcgaaccgagtacctaggacgaccgtaccggacggtaaccgaccgggtacgtaagttggttaactttcgaggtagaccggaaggacggaagtaccgaccgtcctaacgg

SEQ ID NO: 265076 - DNA, 594 bp, Homo sapiens
  misc_feature: GYAE6OF01DZ7MV.34.26.C04.1.454.CMB.1.raw
tcagtacacgtgatcacgaccggtgctcgatttagtctagcgactttgggtttgggggctgggagaggagcccagcactagaggttggcggtgtttccattcggtgatcagcactgaacacagaggactcaccatggagtttgggctgagcttgggttttcctcgttgcttcttttaagaggtgtccagtgtcaggtgcagctggtggagtcgtggggggaggcgtggcccagccgtggggacctccctgacgactctcctgtgcagcgtctggacttcaccttcagtagtcatggcatgcacgtggggtccgccgaggcctccagggcaaggggctgggagtggggtgctagttatagtggtatgatagggaagtagtacaatactatgacagactccggtaggaacgggccgaattccaccgtctaccagacgacaacgtacccaaagaacacgtctagtactcgtgacaaatcgaacctagcccgtaggacgacggacccggagggaaccgacggtacgtaacgttaggttaacttacggtagttagggaccggtaaggaacggaacggaccgaacgccccgtaaaccggg

SEQ ID NO: 265077 - DNA, 678 bp, Homo sapiens
  misc_feature: GYAE6OF01CGM9X.34.26.C04.1.454.CMB.1.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtggggggagcgtggcccagcctgggacctccctgagactctcctgtgcngcgtctggattccaccttcagtagtcagtggcatcgcacgtcgggtcccnccgaggcctccgaggcgaaggggctgggaggtgggtgactaggttatagtggtatgagtggaagtntactaattactagtcgacaacggtaccgttaccggtagggaaccgggtccgtacttcccgaacccggttctacccgaagaacgtaacctaaacgtacccgaaaacgaaaccgtaccgtacgttacgtacttaccgtagtaacctaaacgtaccgtaacccgaacggtacccgtaaggaccggtaaccgggacccggtaaaggtacccggaacgggtaccgttaacgttacggttaaacgtttacgtacgggtacgggtacggtaaggacggtaaacggaaccgtcggtaaccccgtaacgg

SEQ ID NO: 265078 - DNA, 523 bp, Homo sapiens
  misc_feature: GYAE6OF01BP5SF.34.26.C04.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggcccagcctgggacgtccctgagactctcctgtgcagcgtctggattcaccttcagtagtcatggcatgcacgttcgggtcccnccgaggctccgagggcaaggggctgggagtggggngcagttanatggtatgatggaagtgtcaatactangcagctcgtgacggccgatcaccgtcncagacgacaactacccaaagaccacgacttactactcagaactaagaccgacacgtctaggacgacggaccgacgacgacgtacgtagttatactagtgcgagagagagacgcgcgtacg

SEQ ID NO: 265079 - DNA, 605 bp, Homo sapiens
  misc_feature: GYAE6OF01AZGV8.34.26.C04.1.454.CMB.1.raw
  modified_base (356)..(356): a, c, t, g, unknown or other
  misc_feature (356)..(356): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggcccagccgtgggaccgtccctgagactctcctgtgcagcgtctggattcaccttcagtagtcatggcatgcacgtgggtcccgccagggcctccgaggcgaagggggctgggacggtggggtgcagtttanagtgggtatggatggaaagtgtacaatactatgacagactccgtagacgggcgattcgaccgtctacagacgacaatacccaagaaccacgctagtactcgtagacctaaagtcgaaccgagtccctaggacgacggtacccggaacgggaaccgtacgggtaccttaagttacgttaacgtttaccggtacgggttaggtaccgggaagggtaacggaaccggtaaccacgggtaccccgtaaaccgg

SEQ ID NO: 265080 - DNA, 617 bp, Homo sapiens
  misc_feature: GYAE6OF01C9TEC.34.26.C04.1.454.CMB.1.raw
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggcccagcctggggactccctgagactctcctgtgcagcgtctggattcaccttcagtagtcatggcatgcactgggtccncgagctccgaggcaaggggctggaggtgggtgcagttatagtggtatgagtggtaaacgtagtacaattaactagtgacagactccggtaggaacgggccgtaacttcgacccggttctaccgaagtacgaaccaacgtaccccaaaagtaaccacgtacttacggttaactccgtagtaccaaaactcggaaccctagcccttaggacggaaaccggcccggaaacgggaaccgtaccggggtacttaacggttagttaacgtttaacgtggtacgtacggaaggtaacgagaaccgacgacccgtaaccgg

SEQ ID NO: 265081 - DNA, 539 bp, Homo sapiens
  misc_feature: GYAE6OF01E4HTA.34.26.C04.1.454.CMB.1.raw
  modified_base (196)..(196): a, c, t, g, unknown or other
  misc_feature (196)..(196): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggcccagcctgggacctccctgacgctctcctgtgcagcgtctggattccaccttcagtagtcatggcatgcacgtggtcccgccgaggcctccgagggccgaagggggctgggaggtgggtgctagttatagtggtatgataggaagtancaaatctatgcagtactccgtaggacggccagtccaccgtcncagacacaactaccaagacacgctgtactctgaacaagtcgaaccagcctaggacgacggacgacggaccgacgtacgtagtgttaactcgtagtacgacggaagacgacgacacgccgtaacg

SEQ ID NO: 265082 - DNA, 601 bp, Homo sapiens
  misc_feature: GYAE6OF01BGXK9.34.26.C04.1.454.CMB.1.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacgtccctgagactctcctgtgcagctctggattcaccttnagtagtcatggcatcgcacgtcgggtcccnccaggcctccgagggccgaaggggctgggagtggggtgactagttanagtggtatgagtgggaatagtacaaattctaagtgacaagtacctccggtaggaaacgggtccgtaacgtttccgacccgtcctaccgaagacgaacaacgtacccgaaagaaccacgtctagtactctacgacaaatcgaacctacgcctagggaacgaccggaccggaacggtaaccgaacggtacgttaacgttagttaactttcgtaggtacggacggtaaggacgaacgacgacgccctaacg

SEQ ID NO: 265083 - DNA, 879 bp, Homo sapiens
  misc_feature: GYAE6OF01DNPSC.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagtcgttgggttttcctcgttgcttacgttttaagaggttgtccagtgtcgaggtgcagtctggtggagtcggtgggggagcgtcggcccaggccgtgggacctcccgtgacgtcctcgtccgtggtgcgtaggtccgttcgttcggtaactttccctaccgtttacgaggttaacgtccagttcggacctaagttcgaccgtaccggttccgggggtccccaccgacgggtcccttacccggaagggtaccggaaagggggtcctaggggtacggttggggtacggtaacgttaaggttttaagtaggttaggttaagtggtaaacggtagggtaaacgttaacgtaacgtaaattaacgtaagttggaaccgtaacgggttaccgttaccgggagggaaacccggggtcccttaacgtttacccggaacccgtttaccgtaccggaaacggtaaacgtaaaccctaaacccgttaaaccccgaaaacggaaaccgtacccggtacgtttaaggtaacctacgttaacgaaaccgtaaacggtacccggtaaacccgaccggtacccgttaacggggaaccggaaccggtaccccgggaacggtaaccccggtaacggttaccgtttaaaccggttaagttttaacggtttaaacccggtgggttaaaaccggacggtaaaacggaacgggtaaccccggtaacccggtaaaccgcccccggttaaagggg

SEQ ID NO: 265084 - DNA, 597 bp, Homo sapiens
  misc_feature: GYAE6OF01E1B06.34.26.C04.1.454.CMB.1.raw
  modified_base (557)..(557): a, c, t, g, unknown or other
  misc_feature (557)..(557): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccaggcctgggacctccctgacgacctctcctgtcgcagcgtctggacttccaccttcagtagtcatggcatcgcacggttgggtcccgccgaggccctaccgaggcgaaggggtctgggaggtggggtggctagttatagttggtatgagtcggaagtagtacaatactatgacagtaccgtcgaggacggcctattccgaccgttctacgagacgacctaactacccaaagtaaccacgtcttagtactctacgaactaacgtcgaacccacgtacctaggaacggcgtaccgggaacgacccgtaggtacttacgtagttaacttcgnggtaccgacggtaacgaaggaacgcgaacgccgtaaacgg

SEQ ID NO: 265085 - DNA, 626 bp, Homo sapiens
  misc_feature: GYAE6OF01DKTLV.34.26.C04.1.454.CMB.1.raw
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (377)..(377): a, c, t, g, unknown or other
  misc_feature (377)..(377): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgctcttttaagaggtgtccagtgtcaggtgcagctggtggagtcgtgggggagcgtggcccagccgtgggactccctgacgactctcctgtgcagcgtcgtggattccacctttnagttagtcagtcggactatcggctacgtcgggtcccncaggcctaccgaggccgaaggggctggggacgtggggtgactaaggttatagtgggttanggtatagggtaacgttagtactaaatacgtagtgacctaggtacccgtcggtaggtaaacgggcccgtatttccgaacccgtctaaccgaagacgaacctaacgtacccgaacgaactacgcttagtactacgtacgaacaacgtacgtaacccgacgtcgtaggaacgccggtaccggacggaccgtacggtacctagtacgttaattcggtacgtaggacgtacggaacacggaacacgccgtacgg

SEQ ID NO: 265086 - DNA, 562 bp, Homo sapiens
  misc_feature: GYAE6OF01AY7PD.34.26.C04.1.454.CMB.1.raw
  modified_base (454)..(454): a, c, t, g, unknown or other
  misc_feature (454)..(454): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtggtcccgcaggcctccgaggcgaaggggctgggagtggggtgcgtagttatagtggtatggagtggaagtagtactaatacgtatgacacgtacgtccgtaggaacgggcctattcgaccgtctccgagaacgacaactacccgaaacgacacgctntatctagacaaatcgaaccagcctaggacgacgccggagaccgacggtactacgttagttattcgtggttacggcgtaaggacggtaagaaccgacggccctaaccgg

SEQ ID NO: 265087 - DNA, 566 bp, Homo sapiens
  misc_feature: GYAE6OF01BKHJL.34.26.C04.1.454.CMB.1.raw
  modified_base (177)..(177): a, c, t, g, unknown or other
  misc_feature (177)..(177): n is a, c, g, or t
  modified_base (352)..(352): a, c, t, g, unknown or other
  misc_feature (352)..(352): n is a, c, g, or t
  modified_base (434)..(434): a, c, t, g, unknown or other
  misc_feature (434)..(434): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagcgtggtggagtcgtgggggagcgtggcccagccgtgggaccgtccctgacgactctcctgtgcagcgtctggacttccaccttcagtagtcagtggcagtgcacgtcgggtcccgccgaggcctccgagggccgaaggggctgggaggttgggnggctagttatagtggtatgagtggaagtagtacaatactgtgactacgtacgtaccgtaggaacggccgtattccaccgtcncgaagacacaactacccaagaaccgacgtctagtactctacgaacaagtccgaaccgacgcgtacgacgacgccggaacgaccgacggtactagtagttattcgtagtcgacgtagagagacgcgccgtacg

SEQ ID NO: 265088 - DNA, 546 bp, Homo sapiens
  misc_feature: GYAE6OF01B2INH.34.26.C04.1.454.CMB.1.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (379)..(379): a, c, t, g, unknown or other
  misc_feature (379)..(379): n is a, c, g, or t
  modified_base (533)..(533): a, c, t, g, unknown or other
  misc_feature (533)..(533): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttnagtagtcatggcatgcacgtgggtcccnccaggcctccgagggcgaaggggctgggaggtgggcggctaggttanagtggtatgatggaagtagtcaatactangacagacgtcgtggaacgggcgattcgaccgtctacgagacgacaatacccaagaacacgctagtaactcgtagactaactcgaaccacgcctaggagaccgaccggaacggaccacgggactacgtagttacttacgtgtacggcgaagaganacgagccctaacg

SEQ ID NO: 265089 - DNA, 752 bp, Homo sapiens
  misc_feature: GYAE6OF01C2YM1.34.26.C04.1.454.CMB.1.raw
  modified_base (213)..(213): a, c, t, g, unknown or other
  misc_feature (213)..(213): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaaagaggtgtccagtgtcaggtgcagctggtggagtcgngggggagcgtggcccagccgtgggaccgtccctgacgcctctcctgtgcagcgtctggacttcaccttcagtagtcagtggcatcgcacgtgggtcccgccacggcctccgaaggcgaaagggggcgtaggaggtggggtggactaggttattagttgggtataggtagtagggtaaagtaggtactaagttaactagtgacgtaacgtaccgtaccggttaggaacggggtacccgtaatttacccgaacccgttccgtaccgaaacggtaacgaaccgtaaaccgtaacccccgaaaagaaacccgtaacccgttacgttaacgttaaccgttacgtaacgtaaacctaaacggttacggtaaccccgacgggtacccgttaacgggacgggtaaccgggacccggtaaaccgggaaccgtaaccgggtaacgtttaacggttacggtttaaacgtttaaccgggtagggttaaaccggaccgggtaaaacgggtaaaaggaaccgggtaaacccgacggtaacccccgtaaacggg

SEQ ID NO: 265090 - DNA, 512 bp, Homo sapiens
  misc_feature: GYAE6OF01AJ3I9.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtccnccaggctccgaggcaaggggctgggagtgggtgcagttatatgggtatggatggaagtgtacaatactatgcagactcgtgaagggccgattcgaccgtctaccagagacaatacccaagaacacgctagtactctagacaaacgtgaccagcctagagacgcgaggacacggctagtagtattctggtagacgagacgagacagcctacg

SEQ ID NO: 265091 - DNA, 683 bp, Homo sapiens
  misc_feature: GYAE6OF01CEXYJ.34.26.C04.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (674)..(674): a, c, t, g, unknown or other
  misc_feature (674)..(674): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagcgtggtggagtcgtgggggagcgtggcccagccgtgggaccgtccctgacgctctcctggtncagcgttctggacttcaccttnacgtagtcaagtggactagtcgccgtacgtcggggtcccncccgtaaggcctaccgaagggccgaaaggggggtcctaaggggcgggttgggggtacgtacctaaggttttaagtacggtgggttaatggtagtagggtaaacgttggttacctaaaagttaccgttatcggaactacggtaccgttaccggttacggaacgggtacccgtagttacccgacccgttaccgtaccgaaagacgaaccaaccgtaacccgaaacgtaaccgtaccgtacgtaccggtaatccgtagtaaccgtaacgtacgaacccgtcggacccttaggacggtacgaccggacgaaccgacgtcgtaagtgtacttcgagtagacgtacgacgacgaacgngcctaacgg

SEQ ID NO: 265092 - DNA, 538 bp, Homo sapiens
  misc_feature: GYAE6OF01APMMN.34.26.C04.1.454.CMB.1.raw
  modified_base (250)..(250): a, c, t, g, unknown or other
  misc_feature (250)..(250): n is a, c, g, or t
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagcctgggactccctgagctcncctgtgcagcgtctggattcaccttcagtagtcagtggcatgctacgtgggtccgccaggcctcgagggcgaaaggggctgggagtgggtggctaggttatatgggtaatgtagtaggaagtagtcaaatactagngcaagctcgtagaggctatccaccgtntcagagacaactaccgaanaacacgctagtactctagacaagtacgtaccacgaccgtgaagacgacgaggaccaggacctagtagttagttacgtggtagacggagagaagaactagcctaacg

SEQ ID NO: 265093 - DNA, 642 bp, Homo sapiens
  misc_feature: GYAE6OF01BWNGE.34.26.C04.1.454.CMB.1.raw
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (629)..(629): a, c, t, g, unknown or other
  misc_feature (629)..(629): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtggggggagcgtggcccagcctgggaccgtccctgacgctctcctgncngcgtctggattccaccttcagtagtcatggcatgcacgtgggtcccgccaggcctccgaggcgaaggggcgtagggaggtggggtggctaaggtttatagtgggtatggagtgggaaagttacgtcaaatacttagtgacagtaccgtcggtaggaacgggtccgtatttccgaccccgttcgtacccaaggaaccgaacaaacctaacccgaaacgaaacccgaccgtaccgttagtaccttactacgtaactaaacgtccgtaaccgacgtacccgtaggaccggaacggacccggaacgggaaccgacgggtacttagttagttacgttacggtcggtaggtacgaaggtacgaaacggtaccngtacccgtaacgg

SEQ ID NO: 265094 - DNA, 587 bp, Homo sapiens
  misc_feature: GYAE6OF01B77NN.34.26.C04.1.454.CMB.1.raw
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggcccagcctgggacctccctgacgactctcctgtgcagcgtctggacttcaccttcagtagtcatggcatgcacgtgggtcccnccaggcctccgaggcgaaggggctgggaggtgggtgctaggttatagtggtatggataggaagtagtacaaatactangacgaagtaccgtccggtaggaacgggtccgtacttccgtacccgtctaccgaaggaacgaactaaactacccaaagtaaccacgtacgttagtactctagaactaacgtacgaacctacgccgtagacgaacgccggaacgaccgacggtacttagtagttacgttagtggtacgacgagacgaagacacgtacctacg

SEQ ID NO: 265095 - DNA, 579 bp, Homo sapiens
  misc_feature: GYAE6OF01BAI6K.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtcccnccaggcctccgaggcaaggggctgggaggtggggtgctagttatagtggtatggaatggaagttagtcaaatactagtgaccaagtaccgtccggtaggaacgggcccgaagttccacccgtctaccgagaacgacaactacccaaagaaccacgactagtactctgaacaaagtcgaccacgtccgtaggacgacggccggaaggaccgaaccggtactaacgttgttaattcgtaggtcgacggtaagacggaagaccgacgcccgtaacgg

SEQ ID NO: 265096 - DNA, 541 bp, Homo sapiens
  misc_feature: GYAE6OF01BJNXE.34.26.C04.1.454.CMB.1.raw
  modified_base (278)..(278): a, c, t, g, unknown or other
  misc_feature (278)..(278): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagcctgggactccctgagactctccgtgtgcagcgtctggattccaccttnagtagtcagtggcatcgcacgtcgggtcccgccgaggcctccgagggccgaagggggcttagggaggtggggtgcgtagttatagtggtatggatggaagtagtcaatactatgcagtactcggagaacggccgtatccgaccgtctaccgagacacaactacccaaagaacncgactntatactagacaaacgtcgaccagccgtagacgacgccgaggacgacgcgtatagtattcgngtagaggagagagacagcctacg

SEQ ID NO: 265097 - DNA, 508 bp, Homo sapiens
  misc_feature: GYAE6OF01BG883.34.26.C04.1.454.CMB.1.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
  modified_base (472)..(472): a, c, t, g, unknown or other
  misc_feature (472)..(472): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagctctcctgtgcagcgtctggattccaccttnagtagtcatggcatgcacgtgggtccnccaggctccgaggcaaggggctggagtgggtgcagttanagtggtatgatggaatgacaatctatgactagactcgtagaacggctatcaccgtncagagacaactacccaaagaccacgtctagtatctagacaaagtcgaaccagcctgacgacgacgaggacacggntatgtattacggtagacgtagaganacngcgtaacg

SEQ ID NO: 265098 - DNA, 623 bp, Homo sapiens
  misc_feature: GYAE6OF01EWX4T.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagcgtgggtggagtcgtggggggagcgtggcccagccgtgggacctccctgagcctctcctgtgcagcgtctggattccacctttcagttattcatggcatgcacgtcgggtcccgccgaggcctccgagggaccgaaggggcctgggaggtgggtggctaggtttatagtggtatgagtagggaaagtagtactaaagtactatcgacgagtaccgttccggtaggaacgggtccgtacgttaccgacccgttacctaccgaagacgaacctaaccgtaacccgaaagaaccacggtcttacgtactacgtacgtaactaaacgtcgaaccacggtacctaggacgacggaccgaacggaccgaccggtacttacgttagttattacgtcggtcgacgtaggacgaagaccgacgcctaacgg

SEQ ID NO: 265099 - DNA, 641 bp, Homo sapiens
  misc_feature: GYAE6OF01CD6VE.34.26.C04.1.454.CMB.1.raw
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccaggccgtgggaccgtccctgacgacctctcctgtcgcagcgtctggattcaccttcagtagtcatggcatgcacgtgggtcccnccgaggcctccgaggcgaaggggctgggagtgggtgctagttatagtggtatggatgggaaattagtacaaagttactagtcgacgaagtaccgtccggtaggaaaccggggtccgtaacgttcccgtaacccgttctaccgaagacgaaccaaacgttaccccgaaagaacccgaaccgtcttagtaactccgtagaaccaaagttcgaacccaacgtcccgtaggaacgacggaccggaacgggaacccgtacggtacgttaagttaggttaactttacgtggttaggaccggaaggtaaggaacgaaccgacggtacccgtaaccgg

SEQ ID NO: 265100 - DNA, 919 bp, Homo sapiens
  misc_feature: GYAE6OF01B1TG1.34.26.C04.1.454.CMB.1.raw
  modified_base (198)..(198): a, c, t, g, unknown or other
  misc_feature (198)..(198): n is a, c, g, or t
tcagtacacgtgatcacgaccggtgctcgatttagtctagcgactttgggtttgggggctgggagaggagcccgagtcactagacggtcggcggttgtttcctattcggtgtatcagcgactgaacacgagacggacgtcaccgatggagtttcgggctgacgcgttcgggtttttccctcggttgcttcttttaagnggtggtccagtgtcaggtgcagctggtaggacgtcgtcgggggagtcgttggtacccagccgtcgggaccgtaccctagaacgaccttctccgtggtgcacggcgtccgtaggaacttcgaccctttcgaacgttacgtacagtcggctaagttcgccgacgttcggggttccccggacccggtacgggtcccgttcccggaaggggacccgtaaagggggtccgtagggggtacgggttcgggggtacgggtaccgttaaggtttaaggtaaggttaggttaacttacggtaacgtttacgggtaaacgttacgttaactaaagttaaccgttagtaccggtaccgtaacggtacccggttaccgggtacgggtaaaacgggggtccccgttaagttttccccggtaaccccggtttaccgtttaccggttaaacggttaaccggtaacccgtaaacccgtttaccccgaaaaggtaaacccgttaccggtttcgttttaaccggtttaccttaccggtaccgttaaccgtaaaacgtcccgggtaaaccccggtaaacggttcccggttaaagggaaccggtaccgggtaaccccgggaaaggttacccgggaaacccgggtttcttaacgggttacgtttaaccgtttacggttaaccggttcggaaccggttaacgggtaccgtaaacgggtcccgaacccggttccccctaacggg

SEQ ID NO: 265101 - DNA, 755 bp, Homo sapiens
  misc_feature: GYAE6OF01C3C9B.34.26.C04.1.454.CMB.1.raw
  modified_base (112)..(112): a, c, t, g, unknown or other
  misc_feature (112)..(112): n is a, c, g, or t
  modified_base (226)..(226): a, c, t, g, unknown or other
  misc_feature (226)..(226): n is a, c, g, or t
  modified_base (525)..(525): a, c, t, g, unknown or other
  misc_feature (525)..(525): n is a, c, g, or t
  modified_base (712)..(712): a, c, t, g, unknown or other
  misc_feature (712)..(712): n is a, c, g, or t
tcagtacacgtgatcacgaccggtgctcgatttagtctagcgactttgggtttggggctgggagaggagcccagcactagaggtcggcggtgtttccattcggtgatcgganactagaacgaacagaggacgtaccaccactaggtggttgggtcgtgtaggcgttcgggtttttccgtttccgttgtcttacgttttaaggtaaggtgtctacgtgtcgaggtgnagtcgtgggtgggtaggtacggtggggagggcggtcggcccgaccggccggtcgggtaccggtcccttgaacggtaccttccttccgtcgtgacgtacgcgttccgtgtaacgtttcctaccgttactaaggtatacggactggtacgtatcggtcgtaccgtccggtccggacctacggccgtccgaacgggaggaccggggtagggtggtaggtcggggtgacttagttaagtttagaggtaggttaggacggttaaggaaagttaacccggttataaaccttagttagtggaaccncggttaacccgtacgggtacgggtaacggaccggtttaaccttccgtaccccggttactcccgaaaggtaacgtaaaaccaccttaaccccggaaagaacccgtaacggtctacggtaataccgtacgaactaacacggccgtaagcgtgaacgacggaccgtaacggcgtacgtagtcgtaagttnttacgtggagactagggaacgacgccaaccggtcagtaccggg

SEQ ID NO: 265102 - DNA, 798 bp, Homo sapiens
  misc_feature: GYAE6OF01CNCXQ.34.26.C04.1.454.CMB.1.raw
  modified_base (164)..(164): a, c, t, g, unknown or other
  misc_feature (164)..(164): n is a, c, g, or t
tcagtacacgtgatcacgaccggtgctcgatttagtctagcgactttgggttgggctgggagaggagcccagcactagaggtcggcggtgtttccattcggtgatcagcactgaacacagaggactcaccagtggtagtttggctggagtcgttgggttttccncgttgcttacgtttaaggaggtcgtaccagtgtacgaggtgacgaggtcgtgggtggagtcggtggggggacgtcgtcggccgacggtccggtagggacctccgtgtacgtacttccgtccgtgtcgacgacggtcgtacgtacggtacttcctaacggttcgacggtacgtcgagtcgggtacctaggttcggaccggtaccggtcggtcccgacggtacgtccgtaccggagggacggtaacggggtccgttaggggacggtacgggggttactacggttaaggttaacgtagttacggtagtacggtaaggtacggtaaggtacgtactaaacgttacgtacggtacgtacgaaccgggttaccgtcgggtaacgggtaccggtttaacccgtattaccccgtaaccggttactaaccggaacgtaaccggtaaacccgtaacgttaacccggaaaacgtccccgtaacggttacgggttaactaaccggttaacgtaacggtaaccgtaaaccgttccgaaaccgtacggtacggtaacggacgaacccggaccggtacggaccgtaccgttataccggttagtaccttggcgtacggacgttaacgcggaaactccggtctcgtaacgg

SEQ ID NO: 265103 - DNA, 648 bp, Homo sapiens
  misc_feature: GYAE6OF01DNVAY.34.26.C04.1.454.CMB.1.raw
  modified_base (323)..(323): a, c, t, g, unknown or other
  misc_feature (323)..(323): n is a, c, g, or t
  modified_base (612)..(612): a, c, t, g, unknown or other
  misc_feature (612)..(612): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcggtggccccagcccgtgggacctccctgacgtacctctcctgtgcagtcgtctggacttccaccttcaaggtacgtcagtggcatcgcacgtcggggtcccnccgaggcctaccgagggtcgaaggggctgggaggtggggtgctagttagtgtgggtatggatgggtaaatagtacaaattactagtgactaaggtaccgtcggtaggaacgggtacctattaccgtacccgtctaaccgaagaaccgtaactaacctaccccgaaaagaactacgttcgtacgttgtactaccgtacgaacgtaaacgttaccgaacctaccggtacctagggaccgaacggacccggaacggtacccgaacgggtacttaggtacgttaacgttacgnggtacgtacggaacggtagaacgacgcgtaaccccg

SEQ ID NO: 265104 - DNA, 591 bp, Homo sapiens
  misc_feature: GYAE6OF01AK5IY.34.26.C04.1.454.CMB.1.raw
  modified_base (388)..(388): a, c, t, g, unknown or other
  misc_feature (388)..(388): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggcccagccgtgggaccgtccctgacgaccttctccgtggtcgcaggccgtcgtggtacttccaacctttcagttacgtcatggcatgcacgtgggtccgcaggctccgaggcgaaggggctggagtgggtgctagttatagtggtatggatagggaagtagtnaaatctatgcacgtactcggtaggagggtccgtagttccgaccgtctaccgagaacgaccaaactacccgaaacgaaccacgactagtactctaggaacctaaagtcgtaaccgacgtcctaggacgacggacccgaaggtaccgacggtactaagtaggttattacgtaggtgacgtaaggacgtaacgacacgcctaacgg

SEQ ID NO: 265105 - DNA, 633 bp, Homo sapiens
  misc_feature: GYAE6OF01CN14Q.34.26.C04.1.454.CMB.1.raw
  modified_base (178)..(178): a, c, t, g, unknown or other
  misc_feature (178)..(178): n is a, c, g, or t
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgcttcttttaagnggtgtccagtgtcaggtgcagcgtgggtggagtcgtgggggagcgtggcccagcctgggacctccctgagctctcctgtcgcagcgtctggtacttcaccttgagtagtcatggcatcgcacgtcgggccnccaggcctacgaggcgaaggggctgggagtggggtcgcgtaaggtttaatagtggtaacnggtaagtagggtaaacgtagtaacaaattacgtagtcgacaacggtaccgtccggtaggaacgggtccgtattaccgacccgtctaccgaacggaacgaacctaaacgtacccaaagaaccacgtacttagtacctacgtacgaacctaaacgtcgaaccgtacgcgtacggaacggaccggaccggaaggaacccgtaggtacgttaagttagttaacttacgtcggtcggacgaacggacgaagaccgaccgtaccgtacgg

SEQ ID NO: 265106 - DNA, 756 bp, Homo sapiens
  misc_feature: GYAE6OF01DKEH4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggttttcctcgttgcttcttttaagaggtgtccagtgtcaggtgcagctggtggagtcgtgggggagcgtggcccaggccgtgggaccgtccctgagacctctcctgtgcagctctaggacttcaccttcagttagcagtggcagtcgaccacgttcgggtcccaccagggccctaccggaggacggtaacggggtctgggaaggttggggtcgactaaggtttaactagtgggttaatggaagttaagggaaagttacggtaacctaaattaaccgtagtggaaccctaaggtacccgttccgggtaagggaaaccggggtcccgtaactttacccgaacccggtttacctaacccgaaggtaaccggtaaaccctaacgttaccccgaaaagaacccgtacgtactacgttaacttcgtagaaccctaaagtccggaaaccctacggacccgttaagggaacggaccggaacccgggaacggtaccgtaaacccggggtactttaaaggttaaccggtttacgtttaaccgttacgggtaccggaacccgggtaaaggtaaacccggaacgaaacccgtaaccggtccccgtaaaccggg

SEQ ID NO: 265107 - DNA, 534 bp, Homo sapiens
  misc_feature: GYAE6OF01ATE4K.34.26.C04.1.454.CMB.1.raw
  modified_base (243)..(243): a, c, t, g, unknown or other
  misc_feature (243)..(243): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgctcttttaagaggtgtccagtgtcaggtgcagctggtggagtcgtggggggagcgtggcccagcctgggactcccngagctctcctgtgcagcgtctggattcaccttcagtagtcatggcatgcgactgggtccgccaggctccaggcgaaggggctgggaggtggggtggctagttatagtggtatgagtggaagtagtacaatactatgacagactccggtggaagggccgtagttcacccgtctccgagacgacaactacccgaacgaacacgctntatcgtagacaancgaccagcctagagacggccgaggaccgacgcgtagttagtattcgtgtacgcggagaggagacagccgtaccg

SEQ ID NO: 265108 - DNA, 894 bp, Homo sapiens
  misc_feature: GYAE6OF01B4OJ1.34.26.C04.1.454.CMB.1.raw
  modified_base (104)..(104): a, c, t, g, unknown or other
  misc_feature (104)..(104): n is a, c, g, or t
  modified_base (182)..(182): a, c, t, g, unknown or other
  misc_feature (182)..(182): n is a, c, g, or t
  modified_base (467)..(467): a, c, t, g, unknown or other
  misc_feature (467)..(467): n is a, c, g, or t
  modified_base (665)..(665): a, c, t, g, unknown or other
  misc_feature (665)..(665): n is a, c, g, or t
tcagtacacgtgatcacgaccggtgctcgatttagtctagcgactttgggtttgggctgggagaggagcccagcactagaggtcggcggtgtttccattcggtnatcagcactgaacacagaggactcaccagtggagtttggctgagtccttgggttttcctcgttgcttacttttaaggnggtcgtccagtcgtcaggtcgcagtcgtgggtggacgttcggtaggggggacggtcgtcgggaccccaggtcccgttagggggaccttccccgtaggaacgaccttccttccggttggtcgaccgtaggtccgttccgtagggtaactttcctaaacccgttttcgaaagtttagtccaagtttccggaccttaaggtcgaaccgtaccggtttcgggggtcccaacccggtacggtcctacccggagggttacccggaaagggggttcctagggggtaccgggnggggttggacctagggtttaattaggtggtaagttggaaagttaggggtaaagtaggttaccccaaagttaacttacggagtaacgaacgttaaccggccggttaacgggaaacgggtccccgttaagtttccccgaacccgggttacctaaccgggtaaagacgggttaaaaccccaaacgttaaccccggtaaaanaaaccggttaccggtacccgttaagtttacacgtttaaccgaaacctttaaaacgcccgtaaccgtacccgaacgtggaccgggaacgggaccccgaaagggacccggtttaaacgcccggttttaaacttaggggttaaaacccccttttacggggttacggaaggttaaacccgggtaacgggtttaggaaaaacccgcccggaacgttttacccccggtaaacggg

SEQ ID NO: 265109 - DNA, 646 bp, Homo sapiens
  misc_feature: GYAE6OF01CFZ5B.34.26.C04.1.454.CMB.1.raw
  modified_base (327)..(327): a, c, t, g, unknown or other
  misc_feature (327)..(327): n is a, c, g, or t
  modified_base (636)..(636): a, c, t, g, unknown or other
  misc_feature (636)..(636): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcgaggtgcagctggtggagtcgtgggggagcgtggcccagcccgtggggaccgttccctggacgtacctcgtcctgtcgcagtcgtcgtggactttccaccttcagtagtcagtggcagtgctagtttcgggcccncgaggcctccgaggcgaaggggctgggagtggggtgctaagttatagtgggtatggaagtggtaaacgtagtacaaattactagtcgactacggtaaccgttccggtaggaaacgggtccgtaagttacccgaccccgttactacccgaaagacgaacctaaaccgtacccgaaaacgaccaccggtacttacgtaacgttcgtacgaacctaaagtccgaaacccgtcggtacccgtaggacgaaccggaccgaggaccgaacggtctacgttagttaacttcgtgtacgacgtaagaaggacaacgngaccgtacgg

SEQ ID NO: 265110 - DNA, 618 bp, Homo sapiens
  misc_feature: GYAE6OF01BWWXB.34.26.C04.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (285)..(285): a, c, t, g, unknown or other
  misc_feature (285)..(285): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (483)..(483): a, c, t, g, unknown or other
  misc_feature (483)..(483): n is a, c, g, or t
  modified_base (579)..(579): a, c, t, g, unknown or other
  misc_feature (579)..(579): n is a, c, g, or t
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagcgtcggtttcncgtagctctttaagaggtntcagtgtcaggtgcagctggtcgagtcgtgggggagcgtggcccaggcccgtggggacctcccgtgacgactctccgtgtcgcagcgttctggatttccaccttnagttacgctagtcggcagtcgactacggtcgggtccncaggcctccgaggctagggctagggacgtgggngctagtttanagtggtanggagtaggtaagtcgtactaaatcgtagtcgacgtagtaccgtccggtaggaacgggtcctaagtttcccgaccgtactaccgaagtaccaacaacgtaccaaagtaccncgcttacgtactactgaactaagtcgtaaccagtacccgtaggaccgacgtaccggaacgaccgtaaccggtacttacgttacgttacttaccggngtacgaacggtagaacggtacgaccgtagtccgtaacgg

SEQ ID NO: 265111 - DNA, 532 bp, Homo sapiens
  misc_feature: GYAE6OF01DM1ZH.34.26.C04.1.454.CMB.1.raw
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggcccagcctgggaccgtccctgagactctcctgtgcagcgtctggattcgccttcagtagtcatggcatgcacgtgggtcccgccgaggcctccgaggcgaaggggctagggagtggggtggcagtttatatgggtatggatggaagtgtacaatactatgnagtactccgtagacggccattcaccgtctaccganacgacaactacccaagaacacgcctagtatctgacaaatgaccacgcctgagacggaccgaggaccaggcgtaagtnttattacgtgtagacgtagagagaacncgctacg

SEQ ID NO: 265112 - DNA, 633 bp, Homo sapiens
  misc_feature: GYAE6OF01EXMOZ.34.26.C04.1.454.CMB.1.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (514)..(514): a, c, t, g, unknown or other
  misc_feature (514)..(514): n is a, c, g, or t
  modified_base (568)..(568): a, c, t, g, unknown or other
  misc_feature (568)..(568): n is a, c, g, or t
  modified_base (576)..(576): a, c, t, g, unknown or other
  misc_feature (576)..(576): n is a, c, g, or t
  modified_base (588)..(588): a, c, t, g, unknown or other
  misc_feature (588)..(588): n is a, c, g, or t
  modified_base (596)..(596): a, c, t, g, unknown or other
  misc_feature (596)..(596): n is a, c, g, or t
  modified_base (625)..(625): a, c, t, g, unknown or other
  misc_feature (625)..(625): n is a, c, g, or t
tcagtacacgtgatcacgaccggtgctcgattttagtctagcgacttttgggtttgggggctgggagaggagcccagcactagaggtcggcggtgtttccattcggtgatcagcactgaacacagaggactcaccatggagtttgggctgagcgtggtttcgcgttagctctttaagaggtntccagtgtcaggtgcagctggtggagtcgtagggggngcgtcggaccccaggccgttgggaccgttccccgngacgtaccttctccgtggtcgcaaggtcgtcgttaggactttccaccgtttcgagttagttccagttggcctagttcgaccggtacgttcgggccccgccgaagggttccccttaccggaggggaccgttaagggcgttgggaggtgggtgaccctaaggtttnaaggtggttaanggtaagtagggtaacgtatactaaattntaggtccgaagacgtacgtaccggtagaacggtcgtaactttaccgcgtttaaccncgaagaacactaacacccgaaataccgagtctagtacacgagttacaagtccanacgtacgngaactccgaggngttaaccngactacgtgatcgagagaacgtgacgaancagcgtac

SEQ ID NO: 265113 - DNA, 672 bp, Homo sapiens
  misc_feature: GYAE6OF01EKYJ6.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttccctcgttgcttcttttaagaggtgtccagtgtcaggtgcagctggtggagtcgtgggggagcgtggcccagccgtgggaccgtccctgacgactctccgtgtgcagcgtctggtacttccacctttcagttacgtcagtggactagttcgcctacggttcggggtcccgccgtagggccctaccgagggaccgaagggggtctaggggaggttggggtcgtactaagtttatagttggtatagtaagttaggaaagttagtactaaaattacgtagtagactaacggtaccgtaccgttaggaacgggtaccgtacgttacccgacccgttaccgtaccgaaggaaccgaactaaacctaacccgaaacgaccgtaccgtacgttacgtacttacgtagaactaaagtccgaaccgacgtaccctaggaccgtaacggacccggaagtaccggacgtcgtaagttagttaattaccgtggtgacggtaggaacgaagaccacgccgtaacg

SEQ ID NO: 265114 - DNA, 842 bp, Homo sapiens
  misc_feature: GYAE6OF01CFNGI.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagctgggttttcctcgttgctcttttaagaggtgtccagtgtcaggtgcagcgtggtggagtcgtgggggagcgtggcccagccgtgggaccgtccctggacgctctccgtgtcgcagccgttcgtggtactttccgaccttcgagttacgtccagttcgggcctagttcggaccgtaaccgttcggggggttccccgacccgtaagggtcccgttacccggaagggccggaaaaagggggggtcccgttagggggtaaacggggttgggggttcgggaccgttaaaggggtttaagttaagttggggtttaacttagggtacgtttaggggttaaaacgtaacggtttaaccaaaagtttaccttaaaggccgttaaccgaacggttaacccggttaccccggttaaggggtaaaaccgggggtccccgttaagtttacccccggaaaccccgggtttcccttaacccggaacgggtaaaccgtaaaccctaaaaccggtttaaccccccgaaaaaggtaaaccccgtaaccggtaccgtttaaggttaacctacggtaccgtaaacgtaaacgttccggtaaccgaccggtaccgtagggaacgaacgggacccggtaggaacccgacggtaactacgttaggttaacttcggtacggttagacggagtaacggacgacgccgacgtaccgg

SEQ ID NO: 265115 - DNA, 612 bp, Homo sapiens
  misc_feature: GYAE6OF01D15FM.34.26.C04.1.454.CMB.1.raw
  modified_base (358)..(358): a, c, t, g, unknown or other
  misc_feature (358)..(358): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccaggcccgtggggacctccctgacgacctctcctgtgcagcgtctggacttcaccttcagtagtcatggcatcgcacgtgggtcccgcaggcctccgagggcgaaggggctgggaggtgggtgctagttanagtggtatggatagggaaagtgtacaatactagtgacaagtaccgtccggtaggaacgggtccgtattccgacccgttcgtacccgaagaacgtaacctaactaccccgaaagaaccaccgtctagtaactcgtaacgaactaaagtcgacacgtccgtaggacgacgacccggaagacccgacggtactaagttagttacgttacgtggtacggacggtaaaggaacggacgaaccgtacggtcccgtaacgg

SEQ ID NO: 265116 - DNA, 742 bp, Homo sapiens
  misc_feature: GYAE6OF01DJUGE.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcttgggttttcctcgttgcttacttttaaggaggttcgtccagttcgtcgaggtcgcaggtcgtgggtggagtcggtgggggaggtcgtcggcccgaggccgtgggacctccgtagacgtaccttctccgtggtcgccgaggtcgtcgtagtacttccactttcgaagttcgctaggtcggcctagtcggaccgtacggtccggggtacccaccgtaggcccgtacggacgggaccggaagggtcgtagggacggttgggacgtacgtagtttaagtaggtaggttagaggtagtagggtaaacgttataacgtaaatcgttaagccgtaacgaacggtaccgtacggtaagggaacgtccgtacgttaccgacccgtctaacggagtaaccaaccgaaacgtacccgaaagaacccgtacgtacgttagtaccgtaacgtacgtaaactaacgacccgtaacgtaccggtacgtaaggaccggaccgttaacggaaccgtaccggtaccgttacgttacgtagttaacccgttagggtacgggacgtaaccggtaaagacggaaccggtaaccgccgtaccgtaaccggg

SEQ ID NO: 265117 - DNA, 851 bp, Homo sapiens
  misc_feature: GYAE6OF01ATPPV.34.26.C04.1.454.CMB.1.raw
  modified_base (179)..(179): a, c, t, g, unknown or other
  misc_feature (179)..(179): n is a, c, g, or t
  modified_base (318)..(318): a, c, t, g, unknown or other
  misc_feature (318)..(318): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaaagnggtgtccagtgtcaggtgcagctggtggagtcgtgggggagcgtcggcccagccgtgggacctccgtgacgctctccgtgtgcagcgtctggtacttcaccttctagtagtcagtcggctagtgctacgtcgggtcccnccgtacggcctaccgagggacgaaggggcttaggggaggtgggtcgcgttaaggttagtagtagggtatacggtaaagtgggtaaaagttacgtacgtaaaaagttaccgtaagtacggaactaacggtacccggttaccgggttaacgggaaaccggggttaccgtaaccgtttaccccgtaaccccggtttaccgtaacccgaaacggtaaaccgtaaacccgtaaacccgttaaccccggaaaaacggtaaacccgtaacccggttacgttaacgtttaaaccgttaccggttaaccgaaaccgttaaaacccgggtaccggaaaccccggttaaccggtaaccccggttaagggaaacccgggaacgggtaacccccgggaaaacgggtaccccggtaaaaccccggggttagtttaaaccgtttaccggggtttaaacgttaccggtttaaccgggtaccgggtaaaccggtaaacgggtaaacggaaaccgggtaacccgtaaacccggttcccgtaaaccccgggg

SEQ ID NO: 265118 - DNA, 723 bp, Homo sapiens
  misc_feature: GYAE6OF01EZAI3.34.26.C04.1.454.CMB.1.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggcccaggcctgggaccgtccctgagctctccgtgngcagcgtctggacttccaccttnagtagtcagtggctagtcgtccacgttcgggtcccgccgacggcctaccggagggaccgaagggggcttggggaaggttggggtacggactaggtttaagtagtacgggtaagttcggaagttggggtaaacgtaggttaactaaaattaccgttagcggtaacgaacggtacccgttaccggtaagggtaaaccggggtccccgttagttacccgtaacccggtcccgtaaccggaaggtaaccggaaccgtaaaccctaccccggaaaacgaacccgacgtaccgtttaagtacgtaccgtaacggaaacctaacgtaccggaaccctacgcccggtaagacggaaccggaccgaagggacccgtacggtacgtttagtagttacggtttacgcggtcgaacggaaggtaacgaagtaacccgtcgtcctaaaccggg

SEQ ID NO: 265119 - DNA, 548 bp, Homo sapiens
  misc_feature: GYAE6OF01CBTHJ.34.26.C04.1.454.CMB.1.raw
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
  modified_base (451)..(451): a, c, t, g, unknown or other
  misc_feature (451)..(451): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggcccagcccgtgggaccgttccctgacgaccttctcctggtcgcaggccgtcccggattccgacctttcagtagtcatggcatgcacgtcgggtccnccaggcctccgaggtcgaaggggctgggagtggggtggcagttatagtggtaatggatggaagtagtcaatactatgcagactcgngaggcatcacgtctcgagagacactaccaagacacgctgtatacngacaatcgaaccagtaccgtgaacgacgaccggaaggtaccacggtactagttcgtattaccgtggtcgacggagacgagacacgtccgacgtacgg

SEQ ID NO: 265120 - DNA, 694 bp, Homo sapiens
  misc_feature: GYAE6OF01C1FN2.34.26.C04.1.454.CMB.1.raw
  modified_base (177)..(177): a, c, t, g, unknown or other
  misc_feature (177)..(177): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (388)..(388): a, c, t, g, unknown or other
  misc_feature (388)..(388): n is a, c, g, or t
tcagtacacgtgatcacgaccggtgctcgatttagtctagcgactttgggtttgggctgggagaggagcccagcactaggaggtcggcggtgtttccattcggtgatcagcactgaacacagaggactcacatggagtttgggctgagcgtggttttcctcgttgcttcttttaagnggtgtccagtgtcaggtgcagcgtggtaggngtcgtagggggngcgtcggccctagccgttgggaccgttcccnggacgcctcctccgtgtacgcaggtcgtcgtaggtaacttccgtaaccttcgtaggtacgtcaagttggctagtcgaccgtacgttcgggcccgacacggccaccggaggacgaacggggctagggtggtggggtcncgttaagttagtaagttggtaatggtagtacgggaagtacgtactaataacgtgtagaccgtagtaccgtaccggtaaggtaaccgggaccgttacgtttacccgacccgtaccgttaccggaaacgtaaccgaaccgtaactaaaccccgaaagaaccggtaactccgttaagtacctacgttaaccgaaacgaacgtaccgacgaccgtacgtaggaacgacggaccggacgaaccgtcgacgttacgtggttaacttacggtgtaccggaggtaacgacgaacgtaccgaccgttccgaacgg

SEQ ID NO: 265121 - DNA, 581 bp, Homo sapiens
  misc_feature: GYAE6OF01D9L1R.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggcccaggcccgtgggacctccctgacgacctctcctgtgcagcgtctggacttccacctttcagtagtcatggcatgcacgtcgggtcccgccaggcctccgaggcgaaggggctgggagttggggtggctaaggtttatagtgggtaatggagtgggaaacgttgtacaaattactatcgacaggtacctccggtaggaacgggcctaagttccaaccgtctaccaagacgaactaactacccaaagacacgtctgtactctacgaactaaatcgaaccagtcctaggacgacggccgaaggaccacggtactagtgttaagttcgtggtagacgaagagacgacacgccgtacg

SEQ ID NO: 265122 - DNA, 673 bp, Homo sapiens
  misc_feature: GYAE6OF01B9RP6.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagcctgggacctccctgacgacctctccgtgtgcagcgtctggattcaccttcagtgtcatggcatgcacgtgggtcccnccaggcctccgagggcgaaggggctgggagtggggtgctagttatgtggtatgagtaggaagtagtcaaattactagtcgacgtaagaccttccggtaggaacggggtccctaagtttcccgacccgtctaccgaagacgaactaacgtaccccaaagaacccaccgtacgttagtaacttacgacgtaaccgtaaagttccggaaccctaaggtacccgttaacggacggtaaccgggaaccccgggaaagggaaccccgtaaacgggtaccttaacggtttaacggttaaacgtttaccggttacggttacggaacgggtaacggaaacggaaccggtaaccgaaccggccccgtaaacccgg

SEQ ID NO: 265123 - DNA, 636 bp, Homo sapiens
  misc_feature: GYAE6OF01ECIBQ.34.26.C04.1.454.CMB.1.raw
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (316)..(316): a, c, t, g, unknown or other
  misc_feature (316)..(316): n is a, c, g, or t
  modified_base (514)..(514): a, c, t, g, unknown or other
  misc_feature (514)..(514): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgctcttttaagaggtgtccagtgtcaggtgcagctggtggagtcgtgggggagcgtggcccagcctgggactccctgagctctcctgngcngcgtctggacttccaccttcagttagtcagtggcagtcgaccacggttcggggtcccnccgagggtccctacccggagggaccgaaagggggtccttaggggaggttgggggtcggactaaggtttagtagttgggtaatggtaggtagggaaacgttagtaccaaattactagtcgactaacggtcctaccggtaggaacgggccgtacttacccgacccgtcaccgagaacgacctaacctaccgaaagaaccncgtacttagtactacacgacaacgtacgaacctacgaccgtagacggaccggaccgagggacccacggtactagttagttattccgaggtcgaacggacgaacgacgacgacgccctaaccg

SEQ ID NO: 265124 - DNA, 790 bp, Homo sapiens
  misc_feature: GYAE6OF01DNJNL.34.26.C04.1.454.CMB.1.raw
  modified_base (379)..(379): a, c, t, g, unknown or other
  misc_feature (379)..(379): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagtcgttgggtttttcctcgttgcttacgttttaagaggtgtccagtgtcaggtgcagcgtgggtggaggtcggtgggggacgcggtcggccccgtaggccgtcggggaccgtcccgtggacgtaccttccgtccgtggtcgccgtacggtccgttcgttcggtaactttccctaaccctttgaacggttacgtcgaagtcggactagttcggacctacggtccggggtcccnccgaggtcctaccggaggcggaaggggtcgtagggaggttggggtcgtacgtaaggtttagtagtaggttagtggtaagtacggtaaagttacgaacttaaagtacgtagtccgagtaacggtaccggtccgggtaacggtaacgggtacccttaacgttacccgtaacccgttaccgaaccgaaacggacgtaaacccgtaacccgttaaacccgaaaaccgaaccgtaaccggtcgttaacgttacgttaaccgtacggtaaacctaaacggtaccgaacccggtaacggtacggtacgggaaccggtaaccgggaccggaacgaccgtaacggtaaccgttaagttcggtttaaacgttcggtacggtacgaacggtaagaagtaaccgaacgtccgtaaccgtacgg

SEQ ID NO: 265125 - DNA, 792 bp, Homo sapiens
  misc_feature: GYAE6OF01AT8WZ.34.26.C04.1.454.CMB.1.raw
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctgttgcttntttaagnggtntccagtgtcaggtncagctgggtggagtcgtgggggagcgtggcccagcccgtgggaccgtccctgacgacctctcctgtgcagcgtctggacttccaccttcagtagtcagtggctagtgccacgtcggggtcccaccgacgggcctaccggagggtccgaaagggggtcctgggtaggtggggtacggacgtaaggtttataggtggtaagtagacggttagggaaagttacgttacaaagttaccgttaagtacgaccgtaacggtaccgttaccgggtaagggaaaccggggtcccgttaacgtttacccgtaaccccggtttaccgtaacccgaaacgggtaaccgtaaaacccgtaaacccgttaaccccgaaaaacgtaaacccgtaccggttaaccttacggttaacttacggtacgtaaaccgtaaaacgttaccggaacccgtaacggtaccccgtaagggaaaccgggaaccggaaccccgggtaaacgggaaacccggtaaccgggttaacgtttaacgttacggtttaaacgtttaacggttcggtaacgggaacggtaacggtaacggaaacggaccgtaacggtaccccgtaaacggg

SEQ ID NO: 265126 - DNA, 644 bp, Homo sapiens
  misc_feature: GYAE6OF01AD0YV.34.26.C04.1.454.CMB.1.raw
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctgggtggagtcgtgggggaggcgtggcccagccgtgggactccctgagctctcctgtgcagcgtctggattcaccttcagtagtcagtggcatgcacgtcgggtccnccaggcctaccgaggcgaaggggctgggagtggggtgctagttatagtggtangatggaacgtgtactaaatactagtcgactacggacctccggtaggaacgggtaccgtagtttacccgtacccggttcctacccgaaggtaaccgaaaccgtaaacctaaccccgaaagaaccgaccgtaccttaggtaacttcgtacgtaacctaaacggtccgaacccgacggtccgtaggaccggaacggacccggaagggaacccgtacgggtacttaaggttacgttaagttaccgtaggtacggacggtaacgaggtaaccgacgacgcccgtaacgg

SEQ ID NO: 265127 - DNA, 896 bp, Homo sapiens
  misc_feature: GYAE6OF01EQY2G.34.26.C04.1.454.CMB.1.raw
  modified_base (877)..(877): a, c, t, g, unknown or other
  misc_feature (877)..(877): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggtttttcctcgtttgcttcgtttttaaaggaggttcgtccaggttgtcgagggttgcaggtcgttgggtggtaggttcggtgggggggacgtcggtcggccccaggtcccgttgggggaacccttcccgtggacgtaccttccgtccgttgtcggccgtaggtccggttcgttggtacttccgtacccgtttcgaaggttagtaccgagttcgggacctaagttcggaccgtaacgggtcccgggggttcccgaccccggtagggtccctacccggaaggggtaccggaaacggggggtccgtttagggggaacgggttgggggtacgggtaaccgtttagggttttaaagtagggtttagggtttaaaggttggtaaacggggtttagggttaaaacggttacggttaaccttaaaaacgttacggtttaaggttacgaaccggtaacggtaacccggttacccggggtaaggtaaaccggggtacccgttaacgtttaccccgtacccggttaccttaaccgaaacgggtaaacctaaccttaaacccggtaaccccgtaaaaggaaacccctaccgggtaactttaaccggttaactaccgaacgtaaaccgtaaacgtcccgaacgtacggacccgtaggaaccggtcgaccggtacggaccgtaccggtacgtttagtagtttacgttaggtacggtacgaacggaggaacgganacccgagacccgtaacggg

SEQ ID NO: 265128 - DNA, 639 bp, Homo sapiens
  misc_feature: GYAE6OF01DMFXM.34.26.C04.1.454.CMB.1.raw
  modified_base (309)..(309): a, c, t, g, unknown or other
  misc_feature (309)..(309): n is a, c, g, or t
tcagtacacgtgatcacgaccggtgctcgatttagtctagcgactttgggtttggggctgggagaggatcccagcactagaggtcggcggtgtttccattcggtgatcagcactgaacacagaggactcacatggagtttgggctgagcttgggttttcctcgttgcttcttttaagaggtgtccagtgtcaggtgcagcgtggtggagtcgtgggggagcgtggcccagccgtgggactccctgacgctctcctgtgcagcgtctggattcaccttcagttagtcagtggcatgctacgtcgggtccncaggcctaccgaggcgaaggggctgggagtggggtgctagttatagtggtatgagtaggaaacgtagtacaattactagtcgacgtaagtaccgtaccggtaaggaaccgggtaccgtaacgtttacccgacccgttcctaaccgaagtaacgaaccaaaccgtaacccgaaagaacccacgtacctaggttaactcgacgaactaaactacgaaccctaggtcctaggacggacggaaccggtaacggaccgtacggtacgttacgttagtttaacgttacgtagtacggtacggaaggtaacgaggaaaccgaccgtccgtaaaccgg

SEQ ID NO: 265129 - DNA, 545 bp, Homo sapiens
  misc_feature: GYAE6OF01EUFKT.34.26.C04.1.454.CMB.1.raw
  modified_base (538)..(538): a, c, t, g, unknown or other
  misc_feature (538)..(538): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgagacctctcctgtgcagcgtctggattcaccttcagtagtcatggcatgcacgtgggtcccgccaggcctccgagggcaaggggctgggagtggggtgcagttatagtgggtatgatggaagtagtcaaatactatgacaggtacctccggtaggaacgggcctattccacccgtctccgaagacgacaactacccaaagaaccacgctagtactcgtagacaaatcgaaccagcctagacgacgccggaaggacgacggtactactagttattcgtgtgacgagacgagacngcctacg

SEQ ID NO: 265130 - DNA, 711 bp, Homo sapiens
  misc_feature: GYAE6OF01CSAGR.34.26.C04.1.454.CMB.1.raw
  modified_base (264)..(264): a, c, t, g, unknown or other
  misc_feature (264)..(264): n is a, c, g, or t
  modified_base (389)..(389): a, c, t, g, unknown or other
  misc_feature (389)..(389): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtcccagtgtcaggtgcagcgtggtggagtcggtgggggacgcgtggcccaggccgtggggacctccctgacgacctctccngtcgcaggtccgtcggatttccacttgagtagtcagtggaccagtcgccgtacgtcgggtcccgcgacggtcctaccgaaggaccggaaggggtcgtagggaggttggggtcggactaggtttanagttgggtaactagggagttagggaaagttacgtaacaaacgtttacaagtcggaactaaggcccgttacggtaggaaccgggtaccgtacgtttaccgacccgttccgtaaccgaagtaccgaactaacccgtaccgaaacgaacccgtacgtacgttaacgtacttaccgtagtaacctaacgccgtaaccgtacgccgtaaggacgaccggaccgtaaggacccgtacggtaacgttagtaaccggtttacgacggttacggtacggtaacgggacgtaacgggaaacgtacccgaaccggacccgttacccggtaggg

SEQ ID NO: 265131 - DNA, 768 bp, Homo sapiens
  misc_feature: GYAE6OF01BIP39.34.26.C04.1.454.CMB.1.raw
  modified_base (178)..(178): a, c, t, g, unknown or other
  misc_feature (178)..(178): n is a, c, g, or t
  modified_base (335)..(335): a, c, t, g, unknown or other
  misc_feature (335)..(335): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaagnggttgtccagttgtcaggtgcagctgggtggagtcgtgggggagcgtggcccaggccgtgggacctccctgacgtcctcgtcctggtcgcagtcgttcgtggtactttccacctttgagttagtcagttcggctagtcgcctacggtcggggtcccnccgtaggcccttaccggagggaccgtaagggggtctaggggtaggttcggggtcgacgttaggttagtagtagggttaatggaaggttacgggtaaagttacgtaactaaacgttacgttaggtacgacgtaacgttaccgttaccgggtaagggaaacccggtccgtaacgttttacccgaacccggttacctaaccggaaacggtaacgtaacccgtaaacgtaccccgaaaaggaaccgtaccggtacttacgttaacgaccgttaacgaaacgtaacggttaccaaccggtacggtcgtaacggaccggacggacccggtaacggtaccgtaacccggttaacgtttaaggtaccggtttagttaaacccgggtcgggttaagacgggttaacgaaccggtacgtaaccggacccggtccgtaaacggg

SEQ ID NO: 265132 - DNA, 588 bp, Homo sapiens
  misc_feature: GYAE6OF01ENEQ7.34.26.C04.1.454.CMB.1.raw
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
tcagtacacgtgatcacgaccggtgctcgatttagtctagcgacttttgggtttggggctgggagaggagcccagcactagagttcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggcccagccgtgggacctccctgacgtacctcctccgtgtgcaggcgtctggactttccacctttcgagtagtcagtggctatcgctacggtcggggtcccgaccgaggcctaccgaggaccgaaggggctagggaggtgggngactagttatagtggtatgacgtggaagtacgtacaaatactangacaagtacctcgtaggacggctattcgaccgtctacagaacaacaactaacccaagaaccgacgtctatctacacgaacaaacgtcgaccagtacagacgacggaccgaggaaccgacggtagttacgtagttacgttacgtgtacgacgtaacggacgtacgacacgcctaacg

SEQ ID NO: 265133 - DNA, 891 bp, Homo sapiens
  misc_feature: GYAE6OF01BN9OX.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcgaggtgcagctggtggagtcgtgggggagcgtcggcccagccgtgggaccgtcccgtggacgtaccttccgtccgtggtacgcgtaggtccgttcgtaggtactttccaccctttcgtaaggtacgtccaagtcgggctagttcggaccgtaccgttcggggtaccccaaccggacgggtcccgtaccgaaggggacccgtaaaggggggtccgttaggggagggttcggggtacgggtaccgtaaggttttaacgtaaggttacggggttaattagggtaagtttaacggggtaaaacgtttacggtaacctaaaagttaaccgttaagtacggtaaccgtaacggttaacccgttaccgggtaagggtaaaccgggtccgttaacgttaccccgtaaccccggttaccgttacccggaaacggtaaaccgtaacccgtaaaacccgttaaccccgaaaacgtaaacccgtaccggtaccgtttacggttaaccgtaacggttacgaaacccttaaacggtaccgtaaacccgtaccgtacccggtaacgggtaacggaaccgggtacccgggtaaacgggtaccccgtaacgggtacccgttaaacggttacgttaaccggttttaccgtacggggttacggaaacccgggtaaggtaaaccgggacctaaacccggtcgtaacccccggttaaccgg

SEQ ID NO: 265134 - DNA, 843 bp, Homo sapiens
  misc_feature: GYAE6OF01DROLW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtgggtggagtcggtgggggaggcgtcggcccaggccgtgggaccgtccctggacgtaccttcctccgtggtgccgaggtccgttcgttgggtactttccaacccttttacgaaggttacgtccagttcgggcctaagtcggtaccgtaccggttccgggggttcccccgacccgaacgggtccctacccggaaggggtaccggaaagggggggtcctagggggtacggttgggggtcggtacgtaaggtttaagtaaggttagggttagtaggaagttagggtaaagttacgtactaaaagttacgtaagtcgacgtaacggtacccgttccgggtaaggtaaaccggggtacccgttaacgtttacccgtaaccccggttaccctacccggaaacggtaaccggtaaacccgtaaacccgttaaacccccgaaaacggtaaacccgtaacccggttaccgttaacggttaacgttacccgtaacgaaacccgtaaacgtaccggtaaacccgtaaccggtaccgtaagggaacggtaaccggaacccgggaacgggtaacccgaaccggttacgttaagttacgtttaacgttacgttacggtaggacgtaaggaacgaacgaccgacgacccgtaacgg

SEQ ID NO: 265135 - DNA, 821 bp, Homo sapiens
  misc_feature: GYAE6OF01DJYCW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagagactcacagtggagtttggctgagtcttgggtttttcctgttgcttcttttaagaggtgtccagtgtcgaggtgcagcgttgggtggaggtcggtgggggagcggtcggacccaggcccgtggggaaccgtcccgtaggacgtaccttcgtccgtgtcgctaggtcgttcgtaggtacctttccaccttttacgaagttacgtcagtcggacagtcggacgtacggttcggggcccaccgacggtcccgtacccggagggaccggaagggggtcgtaggggtacggtggggtacgacgttaaggtttaagtaggttagggttaagtacggtaaggttaagggtaaagtaacgttaacgtaaaagtttaccgaagttacgaccgtaaacgggtacccgttacccgggtaagggtaaacccggggtaccctttaacgttaccccgtaaccccgggttcctaaaccggaaacggtaacggaaaccccttaaaccgtaaacccgaaaacggtaacccttaacggtcttaacggttaactaccggtaataaccgtaaagtccgaaaccgtaccggtacgaacgtaacgggaaccggaccggaaacggaccgtaaccgttagttaaaacgttcggttaaattcccggtaagggtacgaaccggaaggtaaacgaacccggtaacaaccggttccctaaacgggg

SEQ ID NO: 265136 - DNA, 789 bp, Homo sapiens
  misc_feature: GYAE6OF01CI0GC.34.26.C04.1.454.CMB.1.raw
  modified_base (179)..(179): a, c, t, g, unknown or other
  misc_feature (179)..(179): n is a, c, g, or t
  modified_base (214)..(214): a, c, t, g, unknown or other
  misc_feature (214)..(214): n is a, c, g, or t
tcagtacacgtgatcacgaccggtgctcgatttagtctagcgactttgggtttggggctgggagaggagcccagcactagaggtcggcggttgtttccattcggtgatcagcactgaacacagagactcacatggagtttggctgagtcgttggttttcctgttgcttacttttaaggnggtcgtccagttgtcgaggtgcagcgttgggtggnggttcggtggggggacgcggtcggaccccgaggtccggtacggggaccgttcccgtggaacgtccttcctccgtggcgccaggtccgttacgtaggtacttccctaacttcgaagttcgtcagtcggctagtcggacctcggttccgggcccaccggacggtcccgtacccggaaggggaccggtaaggggggtccttaagggggtaggttgggggttacgaaccggtttaaggtttaaggtaagttacggggttaattaggaacggtttagggtaaaacgtttagacttaaaacttacgtaagttccgaacgtaacgtacccggttacggtaacgggtaacgggtaccttaacgttacccgtacccgttaccgtaaccgtaacggtaacccgaccgaaaccgtaaccccgtaaaacgtaacccgtacgtaccgttacgtaacgttacgtacgtaaacgtaacgtaccgaaccgacgttaccgagggacgaacggaccggaacggaccgcgttaacgtcgttagttagttccggtagtacggacggtaacggtacgagaccgcgtacgtaaccgg

SEQ ID NO: 265137 - DNA, 592 bp, Homo sapiens
  misc_feature: GYAE6OF01CSKZW.34.26.C04.1.454.CMB.1.raw
  modified_base (213)..(213): a, c, t, g, unknown or other
  misc_feature (213)..(213): n is a, c, g, or t
  modified_base (376)..(376): a, c, t, g, unknown or other
  misc_feature (376)..(376): n is a, c, g, or t
  modified_base (581)..(581): a, c, t, g, unknown or other
  misc_feature (581)..(581): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtggtggagtcgngggggagcgtggcccagccgtgggacctcctgacgactctctgtgcagcgttctggtattccaccttcgagtagtcatggcatgacactggtccgcaggctccgaggccgaaggggctagggaggtgggtgctagttatagtggtatggagtgggaaatgtanaattactatgacagtcgtaccggtaggacgggtaccctagttaccacccgttactaccgaagtaccgaactaactaaccccaaacgaccacgtcgttagttacttcgtagacgtaaactacgggaccacgaccgtaggacgtacggccggaaacgaccgacggtactaagttgtaattcggtgtacggacgtagaacgagtaacncgaccctacgg

SEQ ID NO: 265138 - DNA, 693 bp, Homo sapiens
  misc_feature: GYAE6OF01EEZHL.34.26.C04.1.454.CMB.1.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctccctagagtacctctcctgtcgcagcgtcgtggtattcgaccttcagtacgtnagtggcatgcacgtgggtccncgngcctcgaggcgaaggggctagggacggtgggtgacgtagttatagtaggtatgagtacggaaaggtgtactaaagtactagtgactaaggtaccgttacggagaacgggtaccgtaatttaccgaacccgttccaaccgtaagaaccgaaaccaaccgtaacccaaacgaaccgtaccgtacgttacgttacgtccgttaacgaacctaaaacgtccgaaccgaaccggttccgttaaggaacggaccggaacccgggaaacgggtaacccgtaaccgggtatttaacgttaagggttaaacttaccggacgggttaccggaaacgggtaggtaaacggaaccgggtaaacgtacccggtacccgtaaacccggg

SEQ ID NO: 265139 - DNA, 589 bp, Homo sapiens
  misc_feature: GYAE6OF01DO3VA.34.26.C04.1.454.CMB.1.raw
  modified_base (302)..(302): a, c, t, g, unknown or other
  misc_feature (302)..(302): n is a, c, g, or t
  modified_base (554)..(554): a, c, t, g, unknown or other
  misc_feature (554)..(554): n is a, c, g, or t
  modified_base (578)..(578): a, c, t, g, unknown or other
  misc_feature (578)..(578): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagaggtgtccagtgtcaggtgcagctggtggagtcgtggggagcgtggcccagcctgggacgtcccgtgagacctctcctgtgcagcgtctggattcaccttgagtatcatggcatgcagtcgggtccncaggctcgaggcgaagggctggagtgggcgcagttagtgtggtatgagtaggaagtagtacaaattacgatggactagacctcggagaacgggtccgattcccgaaccgtctaccgagaacgtaacaaacgtacccaaagtaaccacgtcttacgtaactcgtacggaacctaaagtcgaaaccccgtaggtacctagaagggccgtaaccggaacggaaccgaccggtacgttaacttagttaacttacgnggtcggacggagaacggacgaacngacccgtaacg

SEQ ID NO: 265140 - DNA, 760 bp, Homo sapiens
  misc_feature: GYAE6OF01CFV7G.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggcccaggcctgggacgtccctgacgctcctcgtgtgcagcgtactggatttccgaccttcgagtagtcagtggccagtcgcacgttgggtcccgcgtaaggcctacccgagggcgaaaggggccttagggacggtgggtcgacggtaagttagtacgtggtatggtagtagggaaagttacgtactaaagttaccgttaagtcggtaacgtacggtaccgttaccggtacgggtaaaccggggtcccgtaaacgtttccccgtacccggttacccgttacccgtaaacggtaaccgaacccgtaaaccgttacccgaaaaccgggtaacccgtaaccggtacgttacggttaacccgttacgtaccgtaaaccgttaaacggtaccggtaaaccccgtacggtacccgtaccggtaaggaaccggtacccgggtaacgtacccggacggtaaccgttacgttaggttaacgttaccggttacggtacggttacggaacggttaacggaacggttaaccacccggacccgttaacggg

SEQ ID NO: 265141 - DNA, 628 bp, Homo sapiens
  misc_feature: GYAE6OF01DOM1O.34.26.C04.1.454.CMB.1.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtgggtggagtcggtgggggagccgtggccccaggccgtgggaccttcccgtgacgacctctcctggtncagcgtctggtattccaccttcagtacgtnatggcatgcgtacgtcgggtcccgcgtaggcctccgagggccgaaagggggctaggggaggtggggtggactaggttatagtggtaagtggatagggtaaagtagtacaaagttactagtacgcaagtaccgttcggtaacggacgggaccgtattacccgaacccgtctaccgaagacgaaacacgaacccgaaagaaccgtacgtctagtactcgtacgaactaaagtccgaacacgtaccgtagaacggcgaaccggacggaaccgacggtacttaagtacgttaattacgtgtaggacgaaggaagtacgaccgagccctaacgg

SEQ ID NO: 265142 - DNA, 596 bp, Homo sapiens
  misc_feature: GYAE6OF01AT00H.34.26.C04.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggccccaggcccgtgggaccgtccctggacgactctcctgtgcagcgtctggattcaccttcagtagtcatggcatgcacgtggcccgccgaggcctccgaggccgaaggggctgggaggtgggtggctagttatagttgggtatggagtagggaaagttagtactaaatacttaagtcgacacgtaccgtccggtaggaacggggacctagttccctacccgtcctaccgaacgacgaaccaactacccaaagaccacgctgtatctanacaancgaaccgacgcctaggacgacggaccgacggaccgacggcgttaacgtgtaacgttacgtggtacgacggtaaggacgtagaccgacgtcccgtaaccgg

SEQ ID NO: 265143 - DNA, 707 bp, Homo sapiens
  misc_feature: GYAE6OF01D2J3F.34.26.C04.1.454.CMB.1.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcgttttaagaggttgtccagtgtcaggtgcagcgtgggtggagtcgtgggggacgcgtgcccagccgtgggacctcctganctctctgtncagcgtctggattccaccttcagtagtcagtcggcagtcgcacgtcgggtaccnccgaggcctaccgagggacgtaagggggtctgggaggtggggcgtactaagtttatagtgggtactggagtaggtaaagtcgtactaattactaagtcgaacgacgtacgtccggtaagaccgggaccgtacgttaccgtacccgtcgtaccgaacggaacgtaccgaaaccgtacccgaaacgtaaccaccggtaccgttagtacgtacgtacgtaacctaacgtaccgtaccccgaacgtaccgttaacgggaaacgggacccggaaccggtaacgggacccgtaccggttaacgttaaccgtttacgtttaaccggtttaaccggttaacggtacgggaacgttaaaccggaacggtaaaccgtaaccggtaccgtacccgtaaaccggg

SEQ ID NO: 265144 - DNA, 849 bp, Homo sapiens
  misc_feature: GYAE6OF01BLC10.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgtcttcttttaagaggtgtccagtgtcaggtgcagcgtggtggaggtcggtgggggagcgtcggcccagccgtgggaccgtccctgagcctctccgtgtgcgagcgttcgtggtacttccaccgttccaggtacgttcagtggacagtgccacggtcgggtcccgccgaggtcctaccgagggtacgaagggggtcgtggggtaggtggggtaggtacgtaaggtttaataggttggtaagtaggagtagggtaaaggttagtactaaaagttacgtagttacggaccgtaacggtaccggtacggtaagggtaaccggggtacccgttacgtttaacccgaaccccggttacccgttacccggaaacggtaaaccggtaaaccctaaacccgttaaaccccccggaaaacgggtaaaacccgtaacccgggttacccgtttaacgggtttaacgttaacccgttaaccgggaaaaccctttaaaaccgggaccgttaaacccccggtaaccggtaacccggttaaccgggaaaccgggacccggggaaacccgggaaacgggtaaacccccggaacgggttaaccctttaacgggttacggtttaaacgtttacgggtacggtacgggttaacccggaaaggaacgggtaacgtaacccggaaccgtcccgtaaacccgggg

SEQ ID NO: 265145 - DNA, 593 bp, Homo sapiens
  misc_feature: GYAE6OF01C21E6.34.26.C04.1.454.CMB.1.raw
  modified_base (186)..(186): a, c, t, g, unknown or other
  misc_feature (186)..(186): n is a, c, g, or t
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
  modified_base (577)..(577): a, c, t, g, unknown or other
  misc_feature (577)..(577): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggtggtttcgcgtaggctcttaaagtaggtgcagtntcaggtgcagtctggtggacgtcgtggggggagcggtggacccacgcctggggaccttccctgagtacctctccgngtcgcgagtcggttctaggtatcctacccttgaagttcgtcagttcggacngtcgccgtacgttcgggcccaacggtggccctccgaggcccgaagggtctgggagtgggcgntagttnacgtggactgagtacggaatgactaagtctaggtnccaagtcgtacgtggacggacgtactccacggttccagagacaactaacgacccggaanacgtcgtatacgtanacggtanataagcgacacgcgtacgacgacggtacgacggtacgtacgtagtacgtgttacgttcgtacggtgaacgtagaaacganaaccgcgtaccgtacg

SEQ ID NO: 265146 - DNA, 818 bp, Homo sapiens
  misc_feature: GYAE6OF01D8HUJ.34.26.C04.1.454.CMB.1.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtgcccagcctgggacctccctgacgctctcctgtgcagcgtctggattcaccttnagtagtcatggcatgctacgtggggtcccncaggcctccgagggcgaaggggctgggagttggggtgactaggtttanagttgggtaatggaagtagggaaagtcgtactaaagttactagtcgaccgtaaggtacccgttaccggtaagggtaaaccggggtccgtaacgtttaccccgaaccccggttccgtaaaccccggaaaggtaacccggtaaaccctaaaccggtttaacccccgaaaaagggtaacccctaacccgggtacgttttaaccgggttaaccttccggttaaaggtaaacccgtaaaaacgttcccgggaaaccccgtaagggttacccccgttaagggaaacggggtaccccggaaaccccgggggaaaacgggtaacccggtaaaccgggggttaaccctttaaagggtttaccgggttttaaaacgttttacccgggttaacggggttcccgggaaaacccgggttaaggggaaaacggaaccccgggttaaaacccgaccgggtacccccgttaaaacccgggg

SEQ ID NO: 265147 - DNA, 685 bp, Homo sapiens
  misc_feature: GYAE6OF01AQT6B.34.26.C04.1.454.CMB.1.raw
tcagtacacgtgatcacgaccggtgctcgatttagtctagcgactttgggtttggggctgggagaggagcccagcactagatgtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtcggcccagccgtgggacctccctgagacctctcctgtgcagcgtctggattccaccttcagtagtcatggcatgcctacgttggcccgcgtacggcctaccgaggccgaaggggctagggtaggtggggtggctaaggtttagtagtgggttaagtggaactggggtaaagtcggtaactaaagttaacgttagtacggtactaacggtaccgttaccgggtaggaaccggggacccgttaacgtttcccgaaccgttccctaaccggtaaacgaacgaacctaaactaaccccgaaagaacccgaacgtcgtacgttaagttccagtaacctaaagtaccgaacccgttaccgacgtacggaacggaccggaccggtaggggaacccacgggtaaccgttagttacggttactttaacggtcggtaacggacggacggaaacggactacggaaccgtacccgg

SEQ ID NO: 265148 - DNA, 685 bp, Homo sapiens
  misc_feature: GYAE6OF01CCDLA.34.26.C04.1.454.CMB.1.raw
  modified_base (158)..(158): a, c, t, g, unknown or other
  misc_feature (158)..(158): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgtggtttcncgtagctctttaagagtgtcagtgtcaggtgcagctggtggagtcgtgggggagcgtggcccagtccgtgggacctcctagagctctcgtgtgcgagcgtcgtggnttaccnccttgacgtagtcagtggcctagtcgcctacggtcgggtcccacgacggcctaccgaggaccggtaaggggcgtagggtaggttggggtcgacttaaggtttaagtcgtagggtacgtaggtagttagggaaagttacgtaacctaatttacgttagacgacggtacgtaccggtccggtaagggacgggtaccgtattcccgacccgttactccggaatacgtaaccaaccgtaccgaaacgtacctacgtacgttaggttactactacgaacctaagtaccccgaagtacccgaggttaccggaacggtaaccgggaacccggaaacggacccgtaaccggttaactacgttaggttaaccttaccggtggttacggaaccgtaggaacgaacgactccggtaacccgtacgg

SEQ ID NO: 265149 - DNA, 517 bp, Homo sapiens
  misc_feature: GYAE6OF01BNBR9.34.26.C04.1.454.CMB.1.raw
  modified_base (496)..(496): a, c, t, g, unknown or other
  misc_feature (496)..(496): n is a, c, g, or t
  modified_base (510)..(510): a, c, t, g, unknown or other
  misc_feature (510)..(510): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagacctctcctgtgcagcgtctggattcaccttcagtagtcatggcatgcacgtgggtcccgccaggctccgagggcaaggggctgggagtgggtgcagttatagtggtatgatggaagtagtcaatactatgcagactcgtgaggccgattcaccgtctccagacgacaactacccaaagaaccacgctagtactctagacaaagtcgacccagccgtagacgacggccgaggacacggctagtgtattcngtgcgagagagacngcctacg

SEQ ID NO: 265150 - DNA, 952 bp, Homo sapiens
  misc_feature: GYAE6OF01BQ2P2.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttcttttaagagtcgtccagtgtcgaggtgcagcgtggtggagtcggtgggggagtcgtacggcccaggcccgtgggacctcccgtgacgtcctctccgtgtcgacacggtcgtcgtggtactttacccaccgtttacaggttacgtcgtaacgtcgggtactaacggtcgacccgtaccggttccgggggtaccccgaccggtacgggtccccgttacccggaacggggtaccgggaaacggggggttcccgagggggttaggggttcggggtacgggtaccgtttaaagggttttaagttaaggttaggttaagttaggtaaggtttacgggtaaaagtttacggtaacctaaaacggtttaaccgttaagttccgggtaaacccgtaacgggttaaccccggttaccgggttaacggggtaaaacccggggtccccgtttaaacgttttacccccggaaccccgtttacccggttaaccggaaacggtaaacccggtaaacccgttaaaaccgtaacccccgaaaggtaaaccccgttaacccgttacgttaacgttacctaccgtttaacggaaaccttaaaccggtaccggtaaaccccgtacggttacccgaagggacccggtaaacccggggtacccctaaaaggggaccccgttaacgggttaacccgtttaaacggtttaccggttaacggttttacccgtacgggtaccgggaaccgggtaaaacggtacggtaaaacccggaacccggtaaccgtaccccggtaaacccggg

SEQ ID NO: 265151 - DNA, 809 bp, Homo sapiens
  misc_feature: GYAE6OF01CK6HC.34.26.C04.1.454.CMB.1.raw
  modified_base (265)..(265): a, c, t, g, unknown or other
  misc_feature (265)..(265): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttggctgagcttgggttttcctcgttgccttcgttttaagaggtgtccagtgtcgaggtgcagcgtggtggagtcgtgggggagcggtcggcccaggccgtagggacctccgtgacgctctcctggngcagcgtcgtggtattccgtaccttgagttacgtctaagtggactagttcggcctaacggttcgggccccgaccggaggcccgtaccgaagggtaccggaaacggggcgtacggggaaggttcgggggtaggtacgttaaggtttaagtaagggtaggttaagtaggaagttaagggaaacggttaagtaaccgaaatttaaccgtagtacggaaccgtaacgttaccgggtaacccggtacgggtaaccggggtaccgttaccgttaaccccggttaacccgtccgtaaccgtaaaggtaaccggtaacctaaaaccggttaacccgaaaaccggtaaacctaacccgttacgtacgttaaccttacgtaaccgaacgtaaacggttacccgtaacccaacggtccccggtaaggaaccgggaacccggaccggaaacggtaacccggtaaccggttacgttaacgtttacgtttaaacggttccggttcggaacggtaccggtaacgaaacgggtacgaaccgtaccggacccggtaaaccg

SEQ ID NO: 265152 - DNA, 737 bp, Homo sapiens
  misc_feature: GYAE6OF01DIPHI.34.26.C04.1.454.CMB.1.raw
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggaggtttggctgagtcttgggttttcctgttgcttacgttttaagaggttgtccgagtcgtcgaggtgcagcgtgggtggagtcggtgggggagcggtcggccgagtccgtagggaccgtccgtagaccgtaccttccgccgttgtcgcgtacggtccgtaccgtggtacttcctaccgttacgtagtacgtcagtcggcagtcgccgtacgtcgggtacccncgnggtcccacggacgggtacgaaggggtcgttaggggacgggttggggtcggtacttaaggttagtagggttacgggttagacggtaggtaggtaaaaggttacgtaactaaacggttactaaggtcggtaaccacggtacccgtcggggtaaggtaaccgggtacccgttaacttccccggaaccggttacccacgaaaggtaccgaaaccaccgtaacccgaaaagtaccgacgtcgttaactatacgtagaacctaagccgtaaccacggcgtaacggaacggcggtaaccgaggaccgttaggtcgttaattgggttaacttccgggagaccggtacggacggaacggtaaccgcgtaaccggtacccgtacgg

SEQ ID NO: 265153 - DNA, 698 bp, Homo sapiens
  misc_feature: GYAE6OF01AEMIE.34.26.C04.1.454.CMB.1.raw
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (197)..(198): a, c, t, g, unknown or other
  misc_feature (197)..(198): n is a, c, g, or t
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
  modified_base (678)..(678): a, c, t, g, unknown or other
  misc_feature (678)..(678): n is a, c, g, or t
tcagtacacgtgatcacgaccggtgctcgatttagtctagcgactttgggtttggggctgggagaggagccccagcactagaggtcggcggtgttttccattcggtgatcagcactgaacacagaggactcaccatgggtagtttgggctggagccggttggtttcgcgtaggctacttaagngtgcngtgnagtgnngntggtgaggtcggtggggacgcgtcggcccgtaggcccgagggacctcctgancctntccngttagcgtcgcgttcgtagtactcctaaccttnaggtntacagacggatggtncgacggttcggcccgacagggttccaccgaggtaccgaaggggtnaaggtccgggtgggtaccagtaagtttagtaggttaccggnttaagaggtaaggtataccctaaatataaaccttaggngacccgttaagaaccgtccggtaggaaaccgttcggaccttaaccgccggttactaacccgaagggaaaccaccgtttaaacaacccgtaaacgtaccgaccgtaaagttcgtaaccggttacaacggtaaccgtaaattccgggaaccttaaacccgggacggtacgaccgacggacgttaaccggtacgttactacgttaagttaggtaccggtagttaggtacgtaacgtaacgtaanacggaaccctggtacgtacg

SEQ ID NO: 265154 - DNA, 826 bp, Homo sapiens
  misc_feature: GYAE6OF01B37ZT.34.26.C04.1.454.CMB.1.raw
  modified_base (104)..(104): a, c, t, g, unknown or other
  misc_feature (104)..(104): n is a, c, g, or t
tcagtacacgtgatcacgaccggtgctcgatttagtctagcgactttgggtttgggctgggagaggagcccagcactagaggtcggcggtgtttccattcggtnatcagcactgaacacagaggactcaccagtggtaggtttggctgagtcgttcgggtttttcctcgttgtcttacgttttaaggaggttcgtccaggtgtcgagggtgcagcgtgggtggtaggtcgggtggggggacgtcggtccggacccgtggtcccggtcggggtaccgttcccgtggacgtccttcccgtcgttggcgacgtcggtccggttctaggtaacttccgtacgttacgaaggttacgtcagttcggactagtcgccgtacggtccgggtccaccgacgcccgtaccgagggaccggaggggtcgtaggggtaggtgggtcggtataggttataggtaggtagagacggtaggtaaacgtgttaactaagtacgttagacgtaccggtaagtaccggtttacggaacggggtaaccggtaccgttaaccgttaccggttaccccgtaccgttaacccgggaaagtaaacccgaaacccgtaaacccggtaacccgaaaacgtaaccgtaccgtaccgtttacgttaaccgtacgtaacgtaaacctaacggttaacccgaacccggtaccgtaacggttaaccgggaacggacccggtaaaccgggttaccgaaacgggttaccgtaacgttacgtttaacgttacggtttacggtaccgggtaagtaacgggtaacgaacgggaacctaccggaacccgtacggtaaccgg

SEQ ID NO: 265155 - DNA, 671 bp, Homo sapiens
  misc_feature: GYAE6OF01D1Q02.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggaggtcgtgggggaggcgtggacccaggccgtgggacctccctaggacgtactcctccgtgtcgcaggtcgtcgtggattccaccttcagtagtcatggcatgctacgtcgggtccgccgagcctaccgaggccggaaaggggtccgtagggacggtggggtagacgtagtttatagtaggtataggagtagggtaaagttggtactaaatacgtatggactaacggtccgtacggagggaacgggtccgtacgttacccgaccgttcctacgaacgtaacgaaccaaaccgtacccaaacgaacctaccggtacttacggtacttcgtacgaacctaaacgtcgtaaccacggtacgtaaggacgacggacccgggtaacggaccgaccggtacgtacgttaagttacgttaccgtagggtacggaggtacggaacggtaagtaccgacggtcccgtaaccggg

SEQ ID NO: 265156 - DNA, 808 bp, Homo sapiens
  misc_feature: GYAE6OF01EHNMF.34.26.C04.1.454.CMB.1.raw
  modified_base (179)..(179): a, c, t, g, unknown or other
  misc_feature (179)..(179): n is a, c, g, or t
  modified_base (789)..(789): a, c, t, g, unknown or other
  misc_feature (789)..(789): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaaagnggtgtccagtgtcgaggtgcagcgtggtggagtcgtgggggagcgtggcccagccgtgggaccgtcctgacgctctccgtgtcgcagcgtcgtggtattccacctttcgagtacgtcagtcggcagttcgaccgtacggttcggggtccccgtaccgagggtcccgtaccggaggggaccggtaagggggtccgttaggggaggttgggggtcgtaacgttaggtttaagaggttagggtagttaggaaggtttacggggtaaaacgttaggttaactaaaacgtttacgttaaggtaccggtacgtaacgggttaaccgtccgggttaaggggaaacccgggtcccgttaacgtttacccggtaacccccgttccgaaccggtaacggaaaccgtaaccctaaaacccgtacccgaaaacgtaaccccgtaccggtcgtttaacgttaccgtacgttaaccgaacgtaaacggttacccgaacccggttacgaacccggttaacgggacgtaaccgggaaaccggtaccgggaaccgaccggttattaccggttaagtttaccttcgggtagaaccccggaagggtacggtaaaccgacggttaaaccnccggtaacccgttaccggg

SEQ ID NO: 265157 - DNA, 800 bp, Homo sapiens
  misc_feature: GYAE6OF01EZ9HN.34.26.C04.1.454.CMB.1.raw
  modified_base (792)..(792): a, c, t, g, unknown or other
  misc_feature (792)..(792): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggttttcctcgttgcttacttttaaggaggttcgtccaggttgtcgaggtgcagtcgtgggtggaggtcggtggggggacgccggtcggcccgaggtcccgtgggacccgttcccgtggaccgtaccttcctccgtggtcgcgtaggtccgttcgtaggtacctttcctaacccgtttgacggttagtcgagttcggactagtcgaccgtaccggtcgggtcccgaccgagggtccctaccggaagggaccggtaacgggggtcgtagggggtagggttcggggacggtacgttaaggtttaagtaggttaggtagttaggaagttaacgggtaaagttacgtaacgtaaacttacgtagtcggtaaccgtaacggttacccggttacccgggtaagggtaacccgggtacccttaaccgtttccccggaacccgttacccgtaacgtaaacgggtaaacccgtaaccctaaaccgtaacccccgaaagtaaacccggtaccgtagttaaccgtaccttacggaacgtaaaccaacggtccgaaccgtaccgtacgtaaggacggaccggtaccggaacgtaccggtaagtacgttaggttataccgttggtgacgaacggaatacggacacgcgntaaccggg

SEQ ID NO: 265158 - DNA, 697 bp, Homo sapiens
  misc_feature: GYAE6OF01AO2J9.34.26.C04.1.454.CMB.1.raw
  modified_base (176)..(176): a, c, t, g, unknown or other
  misc_feature (176)..(176): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttggctgagctgggttttcctcgttgcttcttttaagnggtgtccagtgtcaggtgcagcgtggtggagtcggtgggggacgcggtcggcccgagcccgtgggaccgttcccgtggacgtaccttccgtccgtgtacgcacggtcgtcgtaggtactttcctaaccgtttcgaggttacgtcagtcggctagtcgcgtacgtcgggtccncgacggtcctaccggacggcgtaaggggcgtagggacgggtgggtacggcgtagttagtacgttggtaatcggtaagtaggtaagtacgtaactaagttactagtacgtacgtaacgtaccgtaccggtacggtacgggtaccgtaccgttacgtacccggttacgtaacccgtaacgtaacgtaacgtaaaccgttacccgaaagtaccgtacgtccgttacgtacttacgacgtaacaacgtcgtaaccgtacgtcggtacgagtaccgcggtacgaacgtacgtacgttacgtaagttcttaggtacgtacggtacgagtacgaacgaccggtacgacgtacccgg

SEQ ID NO: 265159 - DNA, 767 bp, Homo sapiens
  misc_feature: GYAE6OF01EH6I4.34.26.C04.1.454.CMB.1.raw
  modified_base (333)..(333): a, c, t, g, unknown or other
  misc_feature (333)..(333): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggttttcctcgttgcttcgttttaagaggtgtccagtgtcaggtgcagcgtggtggagtcggtgggggagcggtcggcccagccgtgggacctcccgtgacgcctctccgtgtcgcagtcgtcgtggacttccaccttgagtagtcatcggctagtcgctacggttcggggtccccnccgacgggcctaccggagggtcgaaggggtcttaggggacgttggggtgacgtaagttataggttcggtagtagtaagtagggaaagttacgtaactaaatacgttaagtcgacgtaagtaccgttaccgggtaaggtaaaccgggtccgtaacgtttacccggaccccgttcgaacccgtaaggaaacccgtaaaccgaaaccgttaacccgaaacggtaaacccgtacgtacgtttaacggtattaacccggtacgaacgaaaacgttcggaaacccctgggtaccccgtaaggaaccggtaaccggggacccggtaaacggggaacccgtaaccgggttacttaaacggtttaacggtttaactttacccgggtagttacgggaaacggtaggtaaacgaacggtaacccgaccggtcccgtaaacccggg

SEQ ID NO: 265160 - DNA, 876 bp, Homo sapiens
  misc_feature: GYAE6OF01EAIKC.34.26.C04.1.454.CMB.1.raw
  modified_base (204)..(204): a, c, t, g, unknown or other
  misc_feature (204)..(204): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagcttgggttttcctgttgcttacgtttttaaaggaggtcgtccaggttgtcgaggtncagcgttggtggagtcggtggggggacgcgtggcccaggcccgtgggaccgtcccgtgacgaccttctcctggtagccgaggtccgttcttagggaacttttcccaacccgttttgaaggttaacggtaccaaggtttcgggacctaagtttcggccgtaaccggttcggggggtacccccaccggaggggtccctacccggaagggggaccggtaaacgggggggtcctttagggggaacgggttggggggtacggtaccgttaaaggtttaactgggtttaggggtaattacgggaaggtttaagggaaaaggtttgtaaaccgtaaagtttaacctacgttcggaaccgttaacggacccgtttaccgggtaacgggaacgggtaccccgttaagtttccctaacccggtccgtaaccgaagaaccggtaacctaaacccgtaccccgaaaggaaaccccgtacgttacgtttaacgtaacgttactaacgggaaacctaaaacggttcggaaaccccgttacgggtccccgttaaggaaccgggaacccgggtaccgggaaaccgggtaaccggaaccggtacgtttaaacgttaacggtttaagtttaccgtaggggttacgaacgggtaggaaacggtaacgaaccccgtggacccccgtaaacgg

SEQ ID NO: 265161 - DNA, 794 bp, Homo sapiens
  misc_feature: GYAE6OF01DCZ6A.34.26.C04.1.454.CMB.1.raw
  modified_base (183)..(183): a, c, t, g, unknown or other
  misc_feature (183)..(183): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcacagtggtagtttggctgagtcgttgggttttcctcgttgcttacgttttaaggnggttcgtccgagtgtcgtaggtgccgaggtcgtgggtggtaggtcggtggggggacggtcggtcggcccgtacggtccggttgggaccgttcccgtaggacgtctccgtccgtggtcgccgtaggccgttcgaggtacttccctacttcgtaagtcgtgagtgactagtcgcgtacggtcgggtcccaccgtacggtccaccggagggtaccggtaagggggtcgttagggggtacgggttcgggggtgtaacgttaaggtttaagttagggttagggttaatagggtaacggtacgggttaaaagtaggttaacctaaaggttacctagtacggaccggtaacgtaccggttaacgggtacgggaccggtaccttaaccgtccggtaacccggtaccgttaacggaacggtaaaccaacccgttaaccgaaaccgtaaaacgtacccggtactacggttacgtacctaacgtactaaacgacgtaccgaccgtacgtaccgaaggaccggacggaacccgggactacccggtagtaccgtttaaggtacgttaacgttcggtaggtaccgaaggtaacggaactacccgggataacccgtccggtaacgg

SEQ ID NO: 265162 - DNA, 627 bp, Homo sapiens
  misc_feature: GYAE6OF01CUQL5.34.26.C04.1.454.CMB.1.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (401)..(401): a, c, t, g, unknown or other
  misc_feature (401)..(401): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctgggtggagtcgtggggggagcgtggcccagccgtgggactcctgagctctcctgtgacagcgtctggattcaccttnagtagtcagtggcatgcacgtcgggtcccnccaggcctaccgagggcctaaaggggctgggagtggggtgactaggttatagtgggtaatgaagtaggaaagttacgtacaaattactaagngacaaggtacctacggtaggaacgggaccgtacttaccgacccgttacgtaaccgaacgtaaacgaacctaaacgtaacccgaaacgaaaccacgtacttaagtactacgtacgaactaaacgtaccgaaccacgtacctaggacgacgaccggacggaaccgtaacggactacgttagttaacttacgtagtacgacgtaagaacgaaggacgaacgtccaacgg

SEQ ID NO: 265163 - DNA, 666 bp, Homo sapiens
  misc_feature: GYAE6OF01C8VGA.34.26.C04.1.454.CMB.1.raw
  modified_base (407)..(407): a, c, t, g, unknown or other
  misc_feature (407)..(407): n is a, c, g, or t
  modified_base (656)..(656): a, c, t, g, unknown or other
  misc_feature (656)..(656): n is a, c, g, or t
tcagtacacgtgatcacgaccggtgctcgatttagtctagcgactttgggtttgggctgggagaggagcccagcactagaggtcggcggtgtttccattcggtgatcagcactgaacacagacggactcaccagtggagtttgggctgagtcgttgggttttcctcgttcgccttacgttttaagaggttcgtacctagttggtacgaggttcgccgagtcgtgggtggacggtcggtgggggagcggtcggcccgaggccgtgggaccgtccgtgacgtctcctcgtgtgacagcgtctggcttcctacttcgagttacgtcgagtcggactgtcgcgtacggttccgggcccgccgtacgccgtaccggaggaccggtaaggggtcgtgggtaggtggggtacgngttaagttagtaggtgtagtaggagtaggtaacgtacgtaatattacgtaagtcgactacgtaccgtacggtacggtaacggtccgtacgttaccggtacccgtcgaacgtacgggaacaaccgacgtaacccgaaacgtaccaaccgtcgttacgtacttcgaacgtaacctacgtacgaccgacgtacccgaaggacgacgacgtacgacgtagtacgtgtagtactgcgtagacgtaaggacaagnccgtcgtacg

SEQ ID NO: 265164 - DNA, 784 bp, Homo sapiens
  misc_feature: GYAE6OF01CLBVL.34.26.C04.1.454.CMB.1.raw
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (483)..(483): a, c, t, g, unknown or other
  misc_feature (483)..(483): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttcctgttgcttctttaagnggtntccagtgtcaggtncagctggtggagtcgnggggggagccgtggcccaggccgtgggacctcctgacgtacttcctaccgtgtcgaccgtaggtcggttaccttgggtaactttccaaacccttttcgaaaggtttacgtccgtaagttcggggcctaagttccggaccgttaccggttcggggtcccccgaccgtaaggggtccccttacccggaaggggtacccggaaagggggggttcccttagggggtaacggttcggggggtacggacttaaggttttaacgtaggttgggtttaaanggtaagtaacggggtaaagttaacgtaacaaagtttaccgtaagtcggtaaacgacggttaccgtaccggttaagggaacgggtacccgttaacgttacccgacccgttcgtaccgaagtaaccgaactaacctaaccgaaacgtaaccgaccgtcgtacgtactacgtaacgaacgtaacgtaccgtacgacgtccgttaggacggtacggaccggaaggacccgtacggtacgttacgtacgtttacgttaccggtacgtacggcgtaacggacggacgaccgtaccgtccctaaccgg

SEQ ID NO: 265165 - DNA, 815 bp, Homo sapiens
  misc_feature: GYAE6OF01DSGAK.34.26.C04.1.454.CMB.1.raw
  modified_base (180)..(180): a, c, t, g, unknown or other
  misc_feature (180)..(180): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagcgttgggttttcctcgttgcttcttttaagnggtgtccagtgtcgaggtgcagcgtggtggagtcggtgggggagcggtcggcccgaggcccgtggggaccgtcccgtaggacgtaccttcctccgtaggtcgcctaggtcgttcgtaggtactttccgtaccctttacgtaggttaacgtccgagttcgggacacgttcggaccgtaccggttccggggttccccgaccggtaccgggtcccgttaccgggacgggaccgggtaaagggggtccgttaggggtaagggttgggggtacgtacggttaaggtttagttaaggtacgggtaagtggtaagtaacgggtaaagttagtaaacgtaacttacgtaagtccggacgtaacggtacccgttacggtagggaaccgggtaccgttaacttcccgtaacccgttccgaaccgaaggtaaaccgaccctaaacgtaaccgaaacggaacccgtacttacggttagtaacctacgtacgtaacctacgtaaccgtaacccgtacggtacgtacggaacgggtaacccgaccgggaaaccgtaccggtaccggttattaacggttaggtttaacgttaccggtagggtacggtaacggaaagtacggaacgttaaccggaccgtacgtaacccggg

SEQ ID NO: 265166 - DNA, 675 bp, Homo sapiens
  misc_feature: GYAE6OF01E4QW1.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggcccagccgtgggacctccctgacgtacctctcctgtgccagtcgtcgtggtacttccaccgttcgagtacgtcagtcggctagtcgctacgtcggcccgccgaggcctaccgagggacgaaggggtcgtgggtaggtggggtggacttaaggtttagtacgttagggtagtaggtagttagggtaaagttacgtacgtaaacttaacgtagtacgtactacggtaacccgttcgggtaagggtaaacccgggtcccgtaacgtttacccgacccgtttacgaccaaggtaaaccaccctaaacgtacccgaaagtaccgtacgtcttacgtatctagtaacaagtcgaacctagcctagacggcgaaccggaggaccacggtacgttagtaccggttaaattccgttgggtaaacgcgtaaagggccaaacgggacacggtcccgtaacgg

SEQ ID NO: 265167 - DNA, 735 bp, Homo sapiens
  misc_feature: GYAE6OF01EUAIJ.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtacggccccaggcccgtggggaccgttccccgtggaacgtaccttcctccgttggtcgcgaggtccgtacgtggattccgacctttnagtagtcagtcggcagtgccgacgtcggggtcccgaccgtaggccctaccgaggccgaaggggtctaggggacgtgggtgacgtaagttagtagtaggtatcgaagtggaaagtgtacaaattacgtatcgacaaggtaccgttccggtaggtaaccgggaccttaacgttcccgtaacccggttacctacccggtaagaaacggaacctaaaccgttaacccgaaagtaaaccctaacggtccgttaaggttaacctacgttacggaaacctaaagtccgtaacccgtaaggtacccgtaggaaccggtacggaaccggaaaccgggaccgtaaacggtaaccgtttaagtagttaacgtttacccggtggtaccggtaacggaaacggtaacgggaaccgtaacgaaccggtacccgttaacggg

SEQ ID NO: 265168 - DNA, 569 bp, Homo sapiens
  misc_feature: GYAE6OF01BQ7NQ.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggccccgggacgtccctgacgacctctcctgtgcagcgtctggattcaccttcagtagtcatggcatgcacgtgggtcccnccaggcctccgaggcgaaggggctgggagtggggtgctagttatagtggtatgatgggaaagttgtacaaattactatgacagtaccgtccggtaggaacgggcctattccgacccgttctaccaagacgaaccaactacccaaagaaccacgctagtactcctagacaaactcgaaccagccgtaggacgacgccggaaggaccgacggtacttagtcgttaattacgtggtcgacgagagacgacacgtcccagtacgg

SEQ ID NO: 265169 - DNA, 594 bp, Homo sapiens
  misc_feature: GYAE6OF01A0IYC.34.26.C04.1.454.CMB.1.raw
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtggggggagcgtggcccagccgtgggaccgtcccngacgactctcctgtgcagcgtctggattcaccttcagtagtcatggctatgctacgtgggtcccnccaggctccgaggcgaaggggctagggagtggggnggcagttatagtggtatgataggaagtagtacaaatactagtgacaggtaacctccggtaggaacggggccgtagttaccgacccgtctaccgaagaacggtaaccaacctacccgaaagaaccgaccgacttacggtactcgtgaacaaagtcgaaccacgtcgtagagacggaccggtaggaccgacggacttacgtagttacttcgtagtggaccgaggaacgagtaaaccgcgtacccgtaccgg

SEQ ID NO: 265170 - DNA, 575 bp, Homo sapiens
  misc_feature: GYAE6OF01AGD9I.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggcccagccgtgggacctccctgagactctcctgtgcagcgtctggattccaccttcagtagtcatggcatgcacgtgggtccgccaggcctccgagggccgaaagggggctggggaggtcggggtggacgtagtttatagtgggtatggatgggaagtagtcaaatactatgcagtacgtcgtagacggccgtatccgacgtctccagacactaactacccgaagaaccacgtctagtactacgtagaactaaacgtcgaaccgacgccgtagacgacgtccggacggaccgacggacgttacgtagttacttacgtggtacgtacgaggagaagaccgagtccgtaacccg

SEQ ID NO: 265171 - DNA, 590 bp, Homo sapiens
  misc_feature: GYAE6OF01EGDUZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtgcagctggtggagtcgtgggggagcgtggccccagcccgtgggaccgtccctgacgacctctccgtgtgcagcgtctggattcaccttcagtagcatggcatgcacgtgggtcccgccaggcctccgagggcaaggggctgggagtggggtgctagttatagtggtatgatggaagtgtacaatactatgacagacgtcggtaggacgggccgagttccacccgtcctaccgagagacaacgtacccaagacacgctgtatctgactaagtcgaacccgagaccctaggacgtaccgggaccggaacggtaccgaaccgggtcttaacgttggtttaaactttcggtaggtacggacggttaaacggagaaacggaccacggtccctaacggg

SEQ ID NO: 265172 - DNA, 779 bp, Homo sapiens
  misc_feature: GYAE6OF01BFT47.34.26.C04.1.454.CMB.1.raw
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtgggtggaggtcggtggggggacggcggtggccccaggcccgtggggaccgtccctggacgtacctctccgtgtcgccaggtcgttcgtacggtatttccacctttcaggttacgtcagtggctagtcgactcggttcgggtccgccgacgggtcctacccggagggcggaaacggggtcggtgggaggttcggggtggtactaaggtttagtagttagggtaagttggtagttacgggaaagttacgtacgtaaattactagtacgacgaacgttccgtacggtagggaaaccggtccggttaacttcccgtacccgtaccgtaccgtaaacggaaccgaaacttaccgaaaccccgtaaacgaaccgtacccgttcgtaacgttaccttacggaaccgtaacgtaataccccggaacctaccgggtaccgtaacgggacgggaacccgggaccggtaaacgggaaaccccgggtaccggtttaaccgttaggtttaaccgttacggtttaaccggtcgggttaacgaaacgggtagaacggtaaccggaccgtaaccggtaccctaacccgggg

SEQ ID NO: 265173 - DNA, 658 bp, Homo sapiens
  misc_feature: GYAE6OF01CPX6D.34.26.C04.1.454.CMB.1.raw
  modified_base (645)..(645): a, c, t, g, unknown or other
  misc_feature (645)..(645): n is a, c, g, or t
tcagtacacgtgatcacgaccggtgctcgatttagtctagcgactttgggtttggggctgggagaggagccccagcactagaggtcggcggtgtttccattcggtgatcagcactgaacacagaggactcaccatggagtttggctgagtctgggttttcctcgttgcttcttttaagaggtgtccagtgtcaggtgcagctggtggagtcgtggggagcgtggcccagccgtgggaccgtccctgacgctcctccgtgtcgcgagcgttctggtacttcctaccttcagtagtcaagtgcatgcacggtcggtcccgccgaggccctaccggaggacgaaacggggtctaggggaggtgggtcggtcgtaagtttagtagttagggtagtacggtagtagggtaaacgttagtaacaaattactagtacgacgaagtaccgtcggtaacggacggtaccgtacgttaccgacccgttacctacgtaagaccgtaaccgaaactaccccgaaacgaaccgtacgtactacgtaatccgtagaacctaaacgtacgaccgacgtaccgtagacggacgaaccggacgaaccggacgtacgttacgtagttaacgttcgaggtacggacgtaggaacaccggtaacnccgttaccgacgg

SEQ ID NO: 265174 - DNA, 624 bp, Homo sapiens
  misc_feature: GYAE6OF01BPOXI.34.26.C04.1.454.CMB.1.raw
  modified_base (364)..(364): a, c, t, g, unknown or other
  misc_feature (364)..(364): n is a, c, g, or t
  modified_base (518)..(518): a, c, t, g, unknown or other
  misc_feature (518)..(518): n is a, c, g, or t
  modified_base (540)..(540): a, c, t, g, unknown or other
  misc_feature (540)..(540): n is a, c, g, or t
  modified_base (596)..(596): a, c, t, g, unknown or other
  misc_feature (596)..(596): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtcggcccaggccgtgggaccgtccctgacgacctctcctgtgcgagcgttcgtaggtacttccaccttcgagtacgtcagtcggcatcgctacgtgggtcccgcgaggcctccgagggcgaaggggtcgtgggacggtgggnggtactaggtttatagtcgggtatggagtagggtaagttagtactaaagttactaagtcgacaacgtacgttccggtaggaacgggtccgtagttcctaacccggtcctacgacgtaacgaactaacgtacccaaacgaaccgactcttacgtntacgtcgaactaacgccgaacncgtaccgtaggaacgacggacgacggtacgacggtctaagttgttacgtctggganaacggagacgaatccgagcccgtaacgg

SEQ ID NO: 265175 - DNA, 895 bp, Homo sapiens
  misc_feature: GYAE6OF01C4PZD.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggccctgagcgttgggttttcctcgttgcttcttttaagaggtgtccagtgtcaggtgcagcgtggtggagtcgtggggaggcgtcggcccagccgtgggaccgtccctagacgtacctctccgtgtgcgacggcgttaccgtgggactttccgtacctttaccgtaggttaacgttccaagttgggacctacgttacggtacccgtaaccgttcgggggttcccccgaccgacggggtacccttaccggaacggggtaccggaaaacggggggtccgttagggggtaacgggttcggggggttacggtaccgttaaagggtttttaacgttaacggtttacggggtttaaattcgggtaaaaggtttaaggggttaaaacggttaacggtttaaacctaaaacgttttaaaccgtaaggtttaccggaaccgttaaacggtaccccggtttaaccggggtaacgggtaaaaccgggggttacccccttaacgtttacccggtaacccccggttacctttaacccggaaacgggtaaccgtaaccctaaaaccgttccccgaaaaacgtaaccctacggtacgtttaacggttactacgttaacgaaccgttaaagtacccgtaaccgaacgtcccgtaagtaccgggaaccgccgggaaacggtaaccgtacggtaccttaaaggttcgttaaacgtttacgtacggtacggaacggtaacggaacggaccgaaccgacgtacccgtaaccgg

SEQ ID NO: 265176 - DNA, 892 bp, Homo sapiens
  misc_feature: GYAE6OF01B0IQL.34.26.C04.1.454.CMB.1.raw
  modified_base (197)..(197): a, c, t, g, unknown or other
  misc_feature (197)..(197): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccctcgttgcttcttttaagaggtgtccagtgtcaggtncagcgtggtggagtcgtgggggagcgtcggcccaggtcccgtgggaccgtccctggacgtaccttctcctgtcgccacgcgtcgtggactttccaccttcgaagttagtcctagttcggactagttcgccgtaccggttcggggtaccccnccgtacggggtcccttacccgggaaggggtacccggtaaacgggggggtccttagggggtaggggttacgggggttacggtaccgttaaagggtttttaacgttaaggtttacggggttaaagtttgggaaaggtttaacggggtaaaacgtttaacggttaacctaaaacgtttaacccgttaagtccggaaccgtaacgttaacccggttaccggtacggggaaaccgggtcccgttaacgtttacccgtaaccccggtttaccacccggtaaaggaaccggtaaaccctaaaacccgttaaaccccgaaacggtaaaccctaccgggttaccttaacggtttaaccgttaccgtaacgtaaacccgttaaacggttacccgtaaacccgtaccgtaccgttaacgggaccggaacccggtaccgggaaaccgggtaaccggtaaccggttaccgttacgttaaggtttaaccgttcggttacgggtacgggaacgtaacggtaacggtaaacggaacccgtaaccggtacccgtaaaccgg

SEQ ID NO: 265177 - DNA, 772 bp, Homo sapiens
  misc_feature: GYAE6OF01DP1Y7.34.26.C04.1.454.CMB.1.raw
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttccngttgcttnttttaaagnggtntccagtgtcaggtncagctggtggagtcgtggggagcgtggcccagccgtgggacctcccgtgacgtacctcttcctggtacgccgaggtccgttcgtggtacttcctaccttcgaaggttctcaggtcggacacgtcgccgtaacggttccgggaccgacgtacggtccctacggagggtaaccggaacggggtccgttaaggggtaccggttggggtaccggtacgttaaaggtttgttaacgggttacgggttaactagggtaaggtacggttaaacgttacgtacgtaaacgttactaggttccggagtaaccggttccgtacggtaaggaccgggtcctacgtacccggtacgtcctaacggaataccgaacgtacccgtaacgaacgacgtaccgtacgttacgtacgttacgaacgtaactaacggttacccgaacggtaaccgttccgtaagggaccggtaaccgtaacccgggtaggtaaacccgtacgggttaacttaacggtttaccctttaacggtacgtaccgggtaacggacgtaaacgggtaacgtaccggtaaccgccgttaccggaaaccgg

SEQ ID NO: 265178 - DNA, 639 bp, Homo sapiens
  misc_feature: GYAE6OF01BMM9E.34.26.C04.1.454.CMB.1.raw
  modified_base (354)..(354): a, c, t, g, unknown or other
  misc_feature (354)..(354): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagttgtcaggttgcagctgggtggagtcgtgggggagcgtggccccaggccctgggacctccctgacgactctcctgtgcagcgtctggattccaccttcagtagtcatggcatcgcacgtcgggtcccgccgaggcctccgaggacgaaggggctagggaggttgggnggctaggtttatagtgggtatggtagtagggtaagttagtactaaatacgttagtgactacggtaccgttccggtaggtaacggggtcccgtacgttaccgtacccgtcgtacccgaaggaccgaaccaaccgtacccaaacgtaacccgtacgtacttacgtactccgtacgaaccaaacgtaccgaaccgtacgtacccgtaggacggacggacccggaacggaccgtacggtacgtacttagttaacttacgtggtagacgaggacgagacgacgccgtacg

SEQ ID NO: 265179 - DNA, 657 bp, Homo sapiens
  misc_feature: GYAE6OF01AEHBJ.34.26.C04.1.454.CMB.1.raw
  modified_base (161)..(161): a, c, t, g, unknown or other
  misc_feature (161)..(161): n is a, c, g, or t
  modified_base (176)..(176): a, c, t, g, unknown or other
  misc_feature (176)..(176): n is a, c, g, or t
  modified_base (240)..(240): a, c, t, g, unknown or other
  misc_feature (240)..(240): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccngttgctcttttaagnggtgtccagtgtcaggtgcagctggtggagtcgtgggggagcgtgcccagccctgggactcccngagactctcctgtcgcagcgtctggattccaccttcagtagtcatcggcatgctacgtcgggcccgcaggcctccgaggcgaaggggctagggagtgggtgactagttatagtggtatgagtgggaatagtactaatactagcgcaagtacgtccggtaggaacggtccgtattccgaaccgtctacgagacgacctaactaccccgaaagaaccgaccgtacttacggttaacttaccgtagtaacctaaaggtcccgaaccgtacgtacccgttacgggaacgaaccgggacccgggtaaacgggtaaccccggtaacgggtaacctttaacggtacgggtttaaacttcggttacgggtacggaccggggtaaacggaacggaaacggaaccctacggaccccgttaaaccggg

SEQ ID NO: 265180 - DNA, 628 bp, Homo sapiens
  misc_feature: GYAE6OF01CSPYU.34.26.C04.1.454.CMB.1.raw
  modified_base (158)..(158): a, c, t, g, unknown or other
  misc_feature (158)..(158): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (528)..(528): a, c, t, g, unknown or other
  misc_feature (528)..(528): n is a, c, g, or t
  modified_base (582)..(582): a, c, t, g, unknown or other
  misc_feature (582)..(582): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgtggtttcncgtgctcttagngntcngncngncagctggtgagngnggggngcgngccagccgtggactccngacgctctctgngcagctgtagnttcaccttnagtgcatggacagtgacncggtcggtcccngacggtccacgaggagtaacggggctagggaggttcgggggctagtagtttaagtaggttggggtataggaggtaagggtaaataccgttacgtaaaattcggtaaatcgtaacgcgggttaaccttccggtaaggggaaacgggtccctaaagttccccgacccggtttactaaccggaaaggttaaccgaaaccaaacccgttaacaaaaccggaacctttcgggaccttaggtaccctttanaccgtaaacgttaaccacgggaccaacggctacggaggaccgacgttacggacnggaccttatacgtattcgagacgagganaggacncgtcgtanacgg

SEQ ID NO: 265181 - DNA, 587 bp, Homo sapiens
  misc_feature: GYAE6OF01DJPZI.34.26.C04.1.454.CMB.1.raw
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
tcagtacacgtgatcacgaccggtgctcgatttagtctagcgactttgggtttggggctgggagaggagcccagcgactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggcccagccgtgggactccctagacgtactctcctgtgcagcgtctggtattcaccttcagtatcatggacatgctacgtcgggtccnccgaggctccgagggcgaaggggctagggngtggggtgcagttntagtggtatgagtggaagtgtacaagttacatgacagacgtcgtagaacgggcctagttccaccgtctaccgagacaacaactacccaaagaaccgacgctagtactcgtacgactaaacgtcgaaccgagacccgtaggacggtacggaacccggaaggaccgtacggacttaacgtagttaattaccgtaggtcgacgggtaggtaacgagtaaaccacgcccgtaacg

SEQ ID NO: 265182 - DNA, 613 bp, Homo sapiens
  misc_feature: GYAE6OF01A3KCB.34.26.C04.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgacgactctcctgtgcagcgtctggacttcaccttcagtagtcagtggctatcgctacgtcgggtcccnccgaggcctccgaggcgaaggggctgggaggtgggngactagttatagtggtagtgagtgggaagtagtcaaatctagtgacagtaccgtacggtaggaacgggtccgtacgttcgaccgtctaccgaacgacgaacctaacgtacccaaacgaaccgtaccgacttacgtaactacagtaaccaaacgtaccgaaccgtacgccgtaaggacggacggaccggaacggacggaaccgtacgttacgtagttacgttacgtgtacggacgtaacggaacggagaaccgacgacccgtacgg

SEQ ID NO: 265183 - DNA, 660 bp, Homo sapiens
  misc_feature: GYAE6OF01AWD3J.34.26.C04.1.454.CMB.1.raw
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtggggggagcgtggcccagcccgtggggacctccctgacgactcctcctgtgcagcgtctggattccaccttcagtatcatggcatgcacgtggtccnccaggcctccgaggcgaaggggcngggagtgggtgacgtagttagtagtggtatcgagtagggtaagtagtacaattactagtcgacgtagtaccgtccggttagggaaccgggtaccgtaacgttaccgtacccgttactaccgagaacgaaccaaaccgtaccgaaacgaacacgtacctagtaacttacgtaacgaaccgtaaacgtcgaacccgtacggtacccgaggaacgggtacgaccggtaccggaaacccgacccggtacgttaacgttacgttaagttaccggttaggtacggaaccgtaagggaacggtaccggaaccgaccggtacccgtaaaccgg

SEQ ID NO: 265184 - DNA, 562 bp, Homo sapiens
  misc_feature: GYAE6OF01D5W51.34.26.C04.1.454.CMB.1.raw
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (521)..(521): a, c, t, g, unknown or other
  misc_feature (521)..(521): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctgagactctcctgtgcagcgtctggatttcaccttcagttagtcatggcatgcacgtcgggtcccgccaggcctccgagggcgaaggggctgggaggtggggtgctagttanagtggtatgatggaaatganaatnatgacagactcgaggaagggccgattcaccgtctaccagacacaactacccaaagaccacgtctagtactctgaactaaagtcgaacctacgaccgtgacgacggccgaacgggacaacggtacttagtggttaacttacgnggtaggacggtaggaacggaagtaacgacgcccgtaaccgg

SEQ ID NO: 265185 - DNA, 715 bp, Homo sapiens
  misc_feature: GYAE6OF01E1XGP.34.26.C04.1.454.CMB.1.raw
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
tcagtacacgtgatcacgaccggtgctcgatttagtctagcgactttggggtttggggctgggagaggagcccagcactagaggtcggcggtgtttccattcggtgatcagcactgaacacagaggactcaccatggagtttgggctgagtcttgggttttcctcgttgcttacttttaaggaggtgtccagtgtcaggtgcagctgggtggagtcggtgggggagcgtcggcccagccgtgggacctcctagacgtcctctcctgtcgcagcgtctggtacttccaccttcagtgtcagtcggcagtgcacgtgggtcccnccgaggtcctacgaggcgaagggctagggagtgggtgactaggttanagtggtagtagaggtaggaagttacgtaactaaagttactagttacgacgtaacgtaaccgtccgggtaacggtaaccggggtacctacgttcccggtaaccccgttacgtacccgaagaaccgaaccgtaaccgtacccgaaacgaaccgtaccgtcgttacgtacttacgtaacgaacgtaaacgaccggtaaacccgacgtaccgtacggtaacggaccggaaccgggaacggtaaacccgaaccgggttacgttacgttaacgggtttaacttacggttaccgggtacggtaaacgggaacggtaacggaaaccggtaaccgaccggtacccgtaacccggg

SEQ ID NO: 265186 - DNA, 682 bp, Homo sapiens
  misc_feature: GYAE6OF01AJWEH.34.26.C04.1.454.CMB.1.raw
  modified_base (339)..(339): a, c, t, g, unknown or other
  misc_feature (339)..(339): n is a, c, g, or t
tcagtacacgtgatcacgaccggtgctcgatttagtctagcgactttgggtttggggctgggagaggagccccagcactagaggtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcggtggccccaggcccgtggggaccgtccccgtgacgtaccttcctccgtggtcgcgagccgtcgtggtacttcccaccttcgagtcgtcagtgggcatgactaccgtgggaccccnccgaggcctaccgaggaccgaaggggtctgggaggtgggtgactagttatagtggtagtgagtacggaagtagtacaaagttctagtcgactacggtaccgtccggtaagggaaccgggtaccctaacgttcccgaaccccggttctaacccggaagaccgtaacccaacgttaccccgaaacgtaaccaccgtcttagtacctctacgaacctaaagtcccgaaccgacgtcgtacggacgaccggccggaagaccggtacggtacgttcgttaaggtttacgttaacgggtcgtaccgggaacgtaacggacggtaaaccggccgaaccgtcccgtaacgg

SEQ ID NO: 265187 - DNA, 796 bp, Homo sapiens
  misc_feature: GYAE6OF01CAA4A.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcgttttaagaggtgtccagtgtcaggtgcagctggtggagtcgtgggggagcgtggcccagccgtgggaccgtccctgacgtcctctccgtgtcgcctagccgttcgtaggtacttccgaaccctttgtaaggtacgttcaagttgggacctagtcgaccgtacggttcggggtccccgaccgtacgggaccctacccggaacggggaccggaaacgggggggtccttagggggtaacgggttcggggggtcggaaccgttaaggttttaagttaagttacggggttaaattgggaaagtttagggggtaaaacgttacggttaaccaaagtttactaacgtgaccgtaaggtacccgtaaccggtacggtaacgggtaccgtaacgttacccgtaacccgtccgttaccgaaacgaacgtaaccaaaccgtaacccgaaacgaaaccgtaccgtaccgttaggttaacttaccgtacgtaactaaacgtaccggaacccgaacgtcccgttaagggaacggtaaccggacccgggaacggaacccgacggtacgtaagttacgttaacgttacgtacggttacggacggtaacggaacgaacggtacgaacgtaacccgtaaccgg

SEQ ID NO: 265188 - DNA, 770 bp, Homo sapiens
  misc_feature: GYAE6OF01D424A.34.26.C04.1.454.CMB.1.raw
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (406)..(406): a, c, t, g, unknown or other
  misc_feature (406)..(406): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttgggctgagtcttgggttttcctgttgcttcgttttaagaggtgtccagtgtcaggtncagcgtggtggagtcgnggggggagcgtggacccaggccgtagggccgttcccagggactaccttccgtccgtgtacggccaggccttcgtaggtactttccgaaccctttnaaggtgtcagtggcagtcganccgtcggggtcccncgtacggccctaccgaggtccgaaggggcttaggggaggtggggcgtactaaggttttacnggtagtgtggaaccgttaggaaaggtacgtataaagtacttaggacgacgacggtaaccgttcccgggaagggtaaccgggtccgtaacgttccgaaacccgttccgtaaccggaggaaccaaccgtaaccgttaaacccaaagggtaaaaccctcggtaacccgttggtaactaacccgtttagggaacctaaaacggtcccggaaaccgttacggtaacccctaggaaaccggaccggtaacccgggaacggttaaacccccgtaagggttacccttacgggttagggttaaacccttgggttaggaacccggaagggtaaacggacgtaaaccggaccgttaaacggcccccgttaagggg

SEQ ID NO: 265189 - DNA, 663 bp, Homo sapiens
  misc_feature: GYAE6OF01B38MV.34.26.C04.1.454.CMB.1.raw
  modified_base (178)..(178): a, c, t, g, unknown or other
  misc_feature (178)..(178): n is a, c, g, or t
  modified_base (253)..(253): a, c, t, g, unknown or other
  misc_feature (253)..(253): n is a, c, g, or t
  modified_base (631)..(631): a, c, t, g, unknown or other
  misc_feature (631)..(631): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagcgtggtggagtcgtgggggagcgtggcccagccgtgggactcctgacgctctcngtgcagcgtcgtggacttccaccttcgagtacgtcagttggctagttgcctacggtcgggtccccgaccgtaacggcctacccgagggaccgaaagggggtcgttaggggtaacgggtggggtcggtacgtaaggtttagtaggttagggtagtaggtaagttacgggtaaagttagtacgtaaaacttactagtcgaactaacggtaccgtaccggtaggaacgggtcctagttccgtaacccgttctacgaagtacgaactaaccgtaacccgaaagaaccacgtaccttagtaactcgttaacgaactaagtccgaacgtacgaccgtaggacgacggtaccggaaggtacaacggtatacgtagtaatttacgngtacgacgagaacgtacgacagtcccgtaacg

SEQ ID NO: 265190 - DNA, 625 bp, Homo sapiens
  misc_feature: GYAE6OF01BF0A1.34.26.C04.1.454.CMB.1.raw
  modified_base (612)..(612): a, c, t, g, unknown or other
  misc_feature (612)..(612): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagcttgggttttcctgttgcttcttttaaggaggtgtccagtgtcaggtgcagctggtggagtcgtgggggagcgtggcccagccgtgggacctccctgacgtctctcctgcgcagtccgtgtggtactttccacctttcgagttagtccagttggctaagtcgcctacggtcggggtccccgccgaggcctaccggagggccggaagggggtctaggggaggtgggtggactaggttagtagtgggtactggtagtggaaatagactaaatagtagtgacgtagtaccgtcggtaggaacggtccgtaacttccgaccgtacctacgacgtaacgaccaaaccgtacccgaaagtaacgaccgtactagtactcgtaacgacgtaaacgtcgaacccaggaccgtaggaaccgacgggtaccgaagaccgacgtgtagttgtaactcgtagtcgagtacgaacgngaccagccgtacg

SEQ ID NO: 265191 - DNA, 752 bp, Homo sapiens
  misc_feature: GYAE6OF01D11JP.34.26.C04.1.454.CMB.1.raw
  modified_base (354)..(354): a, c, t, g, unknown or other
  misc_feature (354)..(354): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggtttttcctcgtttgcttcgttttaagaggtgtccagtgtcaggtgcagcgtgggtggagtcggtgggggagcggtcggcccaggcccgtggggaccgttcccgtaggacgtaccttcctccgtgtcgcgaggtcgttcgtggtactttccacttcgagtacgtcagtggactagtcgacctacggtcggggtacccnccgtaggcctaccggaagggcgaaggggtcctggggtaggtgggtacggctaaggttatggtaggtatggacgttaaggaaagttataacgtaaattacgtagtccgaacgtacgtacgtacggtacggaacgggtctacgttacctacccgtactaccgaagtacgtaaccaaccgtaacccgaaacgaacgtaaccgtcgttacgtaaccgttacgtaacgaacctaaaggtaccgtaacccgacgttaccgacgggtaacggaacccggaaccggggaacccgtaaccggtaaccggttacgtttaaaccgttaggttaacgtttacggtacgggttacgtaacgggaacggttaaacggaacccggtaaccggaccgttaccccgtaaaccggg

SEQ ID NO: 265192 - DNA, 587 bp, Homo sapiens
  misc_feature: GYAE6OF01CFO8Z.34.26.C04.1.454.CMB.1.raw
  modified_base (310)..(310): a, c, t, g, unknown or other
  misc_feature (310)..(310): n is a, c, g, or t
  modified_base (507)..(507): a, c, t, g, unknown or other
  misc_feature (507)..(507): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactcctgacgactctcctgtgcagcgtctggtacttcaccttcagtagtcagtggcagtgccacgtcggggcccnccgaggcctccgagggcgaaggggctgggagtgggtgactaggtttatagtggtatgagttagggaagttagtacaaagttactatcgacagtaccgtaccggtaggaacgggtcctagttcctacccgtctaccgagaacgacaaactacccgaaacgaacaccgtactagtactcgtagaacctaatccgaaccngaccgtaggacgacggaccggacggaccacggtactagtagtaacgttcgtcgtaggacgaagagacgacgcgccgtacg

SEQ ID NO: 265193 - DNA, 854 bp, Homo sapiens
  misc_feature: GYAE6OF01EYSLF.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagttgtcaggtgcagctggtggagtcgtgggggagcgtggcccagccgtgggacctcccgtgacgtactctccgtgtcgcagtccgtctggtacttccgaccttcgagttacgtcagtcggctagtcgcctacggtcgggtcccgaccgaggtcctaccgagggtaccgaagggggtcgtagggaggttggggacggtactaagggtttataacggttggggttaattaggtaagtttaaggggtaaacgtttacgttaacctaaaaatttaaccgttaaggtaccggtaacgtaacggttaaccggttacccgggtaagggaaaccgggggttaccctaacgttttacccgaaccccggtttacccgtaacccggtaaaggtaaacccggtaaccctaaaacccggttaacccccgaaaaaggtaaaccccgtaacccggttaccgttaacggttaaccttacccggttaacgtaaacccttaaaacggttcccgggaaaccctacgggttacccgtaagggaacccggtaacggaacccgggtaaggaacccgtaaccggggtaactttaacgggtttacgtttaacgtttacccggtacgggtacggttaacccgggaaacggtaacggtaaaccgaccggttaacccgtacccgtaaacccggg

SEQ ID NO: 265194 - DNA, 617 bp, Homo sapiens
  misc_feature: GYAE6OF01C24BL.34.26.C04.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctccctgagctctcctgtgcagcgttctggacttcacctttcagttagtcagtggcatgctacgtgggtcccnccgaggcctccgaggccgaaggggctagggaggtgggtgctaagtttagtagtggtanggtagtacgggaagtgtacaagttactagtgacaaggtaccgtacggtaggaacgggtccgtattcccgacccgttctaccgaagacgaacctaacgtaccccgaaagacctaccgtacgtagtacttcgtacgaactaaacgtcgaacccgagtaccgtaggacgaccggaccggaaggaccgacgtacgttaagttagttacttacgtaggtagacggtaaggtaacgagaactcgccgtaacgg

SEQ ID NO: 265195 - DNA, 826 bp, Homo sapiens
  misc_feature: GYAE6OF01ESGEI.34.26.C04.1.454.CMB.1.raw
tcagtacacgtgatcacgaccggtgctcgatttagtctagcgactttgggtttggggctgggagaggagcccagcactagagttcggcggtgtttccattcggtgatcagcactgaacacagaggactcaccatggagtttgggctgagcgttgggttttcctcgttgcttcgttttaagaggtgtccagtgtcaggtgcagcgtggtggagtcgtgggggagcgtggcccaggccgtgggaccgtccctggacgtaccttcctccgttaggttcgaccgtacggtccgttcgttacgggtaacttttcccgtacccttttaccgaaggtttaacggtcctaagttcgggacctaaggttcggacccgtaccggttccggggttccccacccgaaggtccctaccgaaggggtacccgaaagggggtccttaggggaacgggtttggggtacggtaccgttaaaggtttaacgttaaggttaggggttaaccttaggggtaagtttaacggggtaaaaggttacgtaactaaaaagtttaccgtaagtcggacgtaacggtacccgttaccgggttaagggaaaccgggtccgtaacgttacccgacccgtacgtaccgaaggtaacaaaccgtaacctaaccccgaaagtaacccgtacgtacttaacgtacgtacgtaagaaccgtaaacgtccgtaaccgtaacgtacctaagggaaccgacggacccggaaacggaccgtaacggtaccgttaagttcgttaacgttacgtacggtacggtaacggaacggtaacgaacgtaaccgacgtccgtaacccggg

SEQ ID NO: 265196 - DNA, 671 bp, Homo sapiens
  misc_feature: GYAE6OF01CG15G.34.26.C04.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (636)..(636): a, c, t, g, unknown or other
  misc_feature (636)..(636): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtntccagtgtcaggtncagctgggtggagtcgtgggggagcgtcggcccagccgtgggacctccctgacgctctctgtgcagcgtctggacttcaccttnagtagtcagtggcagtgcctacgtgggtcccnccaggcctcgaggccgtaaggggctagggaggtggggtcgacttaaggttataggtggtactggtaagtagggtaaacgttacgtacaaatttaacgtaagtcgacgtaacggtaccgtaccgggtaagggaacgggtcccttaagttacccgacccgttaccgtaccgaaagaccgtaacctaaaccgttaccccgaaaagtaacccgtacgtcgttaacggtacttacgacgttaaccaaacggtccgaacccgtacgtacccgtaagggacgaacgggacccggaacggaccgacgggtacttaggtaagttacttcggngtacggacgaacgtaagacgaaactcgaccctagg

SEQ ID NO: 265197 - DNA, 698 bp, Homo sapiens
  misc_feature: GYAE6OF01AWG9G.34.26.C04.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgngggggngcgtggcccaggcctgggacctccctgacgctctcctgtgcagcgtctggtattccaccttgagtagtcagtggcatcgcctacggtcgggtcccgccgacggcctcccgagggccgaagggggtctgggtaggtggggtgacgtagtttaatagttggtagtaggtagtacggtaaagtacgtactaaagtacgttagtcgaccgtaacggtacccgtaccggtagggaacgggtccgtaactttacccgtaacccggttcctacccgaaggaacgaaccctaaaccgtaaccccgaaacgtaaaccgtaccgtccgttagtaaccttacgtacgaactaaacgtaccgtaacccgaccgtacccgtacggaacggtaccggacccggacgtaaccggacgggtaccttaaagttcgttaacgttacggttaggtacggaacggtaaggaacggtaagaaccgaccgtaccgtacccgg

SEQ ID NO: 265198 - DNA, 698 bp, Homo sapiens
  misc_feature: GYAE6OF01AJHCM.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggttgagcttgggttttcctcgttgcttcttttaagaggtgtccagtgtcaggtgcagctgggtggagtcgtgggggaggcgtggccccaggccgtggggaccgtccctggacgacctctccgtgtcgcaggcgtctggtacttccgaccttcaaggtagtcagttggacagtcgactacgtcggggtcccgccgaggtcctaccggaggaccgaaggggtctgggaggtggggtcgactaggttatagtggtatgagtagggaaagttagtactaaacttacgtagtcggactacggtaccgttaccgggaggtaaccgggccgttaccttaccgtaaccccgttaccgtaccgtaaggaaaccgtaaccctaaccgtaaccccgtaaagaaacccgtacgtacttacggttacttaccgtacgtaacaaacgttcgaacccgtacgtaccgtaagacgggaccgtaccggaacggacaaccggtacttaaggttcgttaacgttacgtacggtacgaacgacggtaacgacgaccgacgccgtccggtaacggg

SEQ ID NO: 265199 - DNA, 773 bp, Homo sapiens
  misc_feature: GYAE6OF01DQP8X.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttcgttttaagaggtgtccaggtgtcgaggtgcagtcgtgggtggagtcggtgggggagcgtcggccccaggtccgtgggaccttcccgtaggaccgtaccttcgtccgtgtcgcgaggtccgtcgttggtactttccacccgtttgaacgttagtcgatgggacctagtcggacctacggtccggggtcccgccgaggtccctaccggaagggtacggaaacggggtctacggggtaggtcggggtagtaccgtaaggtttagtaagttcggtaataggtaagtagggtaaagttacggtaactaaagttaaccgttaaggtcgtaactaaggttcccggtacccggttaacgggacgggtaacccgttacgttacccgtaacccggttcctaaccgtaaggtaaccgtaacctaaaccgttaaaccccgaaacggtaaacccgtacgtaacgttacggtaacttaccgaacgtaaccgaaaacgttccggaacctaaccgggtcctaacggaacggacggaacccggtaacggaccgtacggttacctaaggttacgttaacgttcggtagtcggacggagtaacgacgacgacgcgtaacg

SEQ ID NO: 265200 - DNA, 636 bp, Homo sapiens
  misc_feature: GYAE6OF01CNBEX.34.26.C04.1.454.CMB.1.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtccncgaggctccgaggcaagggctgggagtgggtggcagttatagtggtancgagtggaagtagtacaatactagtgcagactccggtagaacgggccgtattccgacccgttctaccgaagacgacaaacgtaccccgaaagaaccgacgtacctagttaactccgttacggaacctaaaagtccggaacccgtaacggtaccccgttaagggaaccggaacggacccgggtaacggggacccgtacggggtaaccttaagttacggttaaacgtttaccggtaggttacggaacggtacggtaaacgaggtaaaccacgggtcccctaaacggg

SEQ ID NO: 265201 - DNA, 716 bp, Homo sapiens
  misc_feature: GYAE6OF01A6OXC.34.26.C04.1.454.CMB.1.raw
  modified_base (199)..(199): a, c, t, g, unknown or other
  misc_feature (199)..(199): n is a, c, g, or t
  modified_base (594)..(594): a, c, t, g, unknown or other
  misc_feature (594)..(594): n is a, c, g, or t
  modified_base (679)..(679): a, c, t, g, unknown or other
  misc_feature (679)..(679): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgcttcttttaagaggtgtccagtgtcaggtgcagntggtggagtcgtgggggagcgtggcccagtccgtgggactcccgtgacgactcgtcctgtgcagtccgtctaggacttccaccttgagtacgtcaagtggacatcggccaacggtcgggtcccaccgtacggtccctaccgacgggacgaacgggggtcttggggaggttgggggagaccgttaaggttaacttaggtagggttaagtcggtaagttcgggtaaaaagtttaggttaaccctaaaagttaccgttaagtccggaaacgtaaccgtaccggttaccggtaggtaacgggtaccgtactttacctacccggtaccgtacccgaaagaccgaactaaccgtaacccgaaacgtaactacgtacgtacgttacgtctaacgaacctaanaccgtaaaccgacgttaccgacggaacgtaacccggacggaacgaacccgtaaccggttacgttacggttacgttaacttacggngttacggacgtaaggagacgaccgacgcccgtaacgg

SEQ ID NO: 265202 - DNA, 674 bp, Homo sapiens
  misc_feature: GYAE6OF01E3QGG.34.26.C04.1.454.CMB.1.raw
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcaacactgaacacagaggactcaccatggagtttgggctgagcttgggttttcctcgttgctcttttaagaggtgtccagtgtcaggtgcagctggtggagtcgtgggggagcgtggccccagcctggggacctcccngagactctcctgtgcagcgtcgtggattcaccttgagtacgtcagtggcatcgcacgtgggtcccncgaggcctccgaggcgaaggggctggaggtgggngctagttatagtggtatggagtaggaagtgtacaatactagtcgacaggtaccgtaccggtacggaacggggtacccgtactttacccgacccgttacccgtaccgaaggaacgaaacctaacgtaccccaaaacgtaaacccaccggtacttacggtaacttccgtacgaacctaaaagtccgtaacccgacgtacccgtaggaaccggtacggacccgggtaaggacccgtaaccgggacgtttaacgtacggtttaacgtttacggtggttaccggacgtaacgggtacgaacggaacccgacggtaccccgtaacgttaccgggg

SEQ ID NO: 265203 - DNA, 597 bp, Homo sapiens
  misc_feature: GYAE6OF01DD080.34.26.C04.1.454.CMB.1.raw
  modified_base (325)..(325): a, c, t, g, unknown or other
  misc_feature (325)..(325): n is a, c, g, or t
  modified_base (380)..(380): a, c, t, g, unknown or other
  misc_feature (380)..(380): n is a, c, g, or t
  modified_base (476)..(476): a, c, t, g, unknown or other
  misc_feature (476)..(476): n is a, c, g, or t
  modified_base (571)..(571): a, c, t, g, unknown or other
  misc_feature (571)..(571): n is a, c, g, or t
  modified_base (582)..(582): a, c, t, g, unknown or other
  misc_feature (582)..(582): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaaagaggtgtccagtgtcaggtgcagctgggtggagtcgtggggggagcgtggcccagcccgtgggacgtccctgacgactctcctgtgcagcgttctggacttccaacctttcgaagttacgtcagtggcattggctacgtgggtacccncgaggcctccgaggacgaaggggctagggagtgggtaggactagttatagtgtangagtggaaagtgtaacaagtatatgacagtaccgtcggtaagacgggacctacgttccgacccgtcacgaagacgaaccaactacccgaaagaacnccgtatacgtactcgtacgaactaaaggtacgacgtaacgcccgttaagacggtaacgaccggtaacgaccgacgtacttagtagtatttacggngtgacgagganacgacacgctaacgg

SEQ ID NO: 265204 - DNA, 811 bp, Homo sapiens
  misc_feature: GYAE6OF01DSGPN.34.26.C04.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtncagcgtggtggagtcggtgggggagcgtcggcccaggcccgtgggaccgttccctaggacgtaccttcgtcccgtggtcgcgacggtccgtcgtggtacctttcctaccctttnagttagactagtggactagtcgccgtacgtcggggtccccacgacgggcctaccggagggaccgaaagggggtcctaggggtaggtcgggggtacgacgtttaaggttaagttaggttggttaaatgggtaaacgttagggggtaaaagtttaggtaactaaaattaccgttaggtcgtaaccggtaaggtacccggttacccgggtaagggaacggggttacgtacggtaactttaccccggtaacccgttcccgtaaccggaaagtaacggtaaacccctaaaccgttaaacccccgaaaacggtaaaccccgtaacggtaccgtttaacgttaacgtacccgttaacggaaccttaaaacgtccgaaacccgtaaccggtacccgtaagggaaccggaccgggtaccggaaaccggtaaccgtaccgggttacttaacggttacggtttaacttacggtacggtagtaccggaaggtagaaaccgtacgccgtaccg

SEQ ID NO: 265205 - DNA, 674 bp, Homo sapiens
  misc_feature: GYAE6OF01EABXZ.34.26.C04.1.454.CMB.1.raw
  modified_base (371)..(371): a, c, t, g, unknown or other
  misc_feature (371)..(371): n is a, c, g, or t
  modified_base (625)..(625): a, c, t, g, unknown or other
  misc_feature (625)..(625): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggcccagcccgtgggaccgtccctgacgactctcctgtcgcagcgtcgtggactttccacctttcagttacgtcacgtggcagttcgcctacggtcggggtacccgccgagggcctccgagggcgaaggggctaggggaggttcgggngctaggtttatagttcggtattgacgtgggaaagttgtaactaatactagtcgactaacggtccgtcggtaaggaacgggtccgtaacgttacccgtaccgttacgtaccgaagtacgaacctaactaccccgaaagaaccacgtcgttagtacctacgacgtaactaaacgtaccgtaaccgacggtaccctaagggaccgacggtacccggaaaggcccgaaacggtgttaacgttaaggttacgttaccgnggttacgaacggtaggaaacggaaccgaaccggtaccgcccgtaaacgg

SEQ ID NO: 265206 - DNA, 766 bp, Homo sapiens
  misc_feature: GYAE6OF01CIMX0.34.26.C04.1.454.CMB.1.raw
  modified_base (658)..(658): a, c, t, g, unknown or other
  misc_feature (658)..(658): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaagaggtgtccagtgtcaggtgcagcgtgggtggagtcgtggggggacggtcgtcggcccaggccgtcggggaccgttccctagacggtacctccgttccgtggtcgcgacggtcgttaccgtgggtaactttccctaaccttcgtaaggttaacgttccaaggttcgggacctaagttccggccgtaaccggtttccggggccccgaccgtaacgggtcccgttacccggaagggtccggaaaacgggggtccgttggggaacgggttcgggggtacgtacggttaaggtttaagttacggttagggtaaagttacggaggttaggtaaaacgttagttaaccgtaaaagtaccttagtacggaacgtacggtaccgttacgggtaggaacggggtacctaacgttaccgaccgttaccgacgtacgaacgtaaccaacctaccgaaacgaacctaccgtatacgttacacgtgaacctaaanaccgtaacctacgctagggacgaaccggacgaggaccgtaacgggactttagtagttacttacggtcgtaacggacggaacggtacgagaaccgtagccccgtaacgg

SEQ ID NO: 265207 - DNA, 604 bp, Homo sapiens
  misc_feature: GYAE6OF01C7565.34.26.C04.1.454.CMB.1.raw
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (330)..(330): a, c, t, g, unknown or other
  misc_feature (330)..(330): n is a, c, g, or t
  modified_base (510)..(510): a, c, t, g, unknown or other
  misc_feature (510)..(510): n is a, c, g, or t
  modified_base (521)..(521): a, c, t, g, unknown or other
  misc_feature (521)..(521): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttccncgttgctctttagngtgtccagtgtcaggngcagcgtggtggagtcggngggggacgcgnggcccaggccgtgggaccgtccctggacgtctcgtccgtgtgaccaggcgtctggcttcacccttgaagttagtcagtggactagtcggacctacggttcgggtcccnccgacggccgccgagggacgtaaacgggggcttaggggcgtgggggtgtactaaggttaacgtgtagggtataggagtagggaaacgttaggtacctaaatagtaagtgacgagtaccgtcgtaacgggacgggtctacttccgacccgtcaccgagaacgaacacgaaacgaacgaacnccgtatgtacncagacacacgactagcgagacgacgacggacgctacgtactagtagttagtcgtagagaacgtaggacaacgcaccgtcgacg

SEQ ID NO: 265208 - DNA, 633 bp, Homo sapiens
  misc_feature: GYAE6OF01CF4S4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgcttcttttaagaggtgtccagtgtcaggtgcagctggtggagtcgtgggggaggcgtggccccaggccgtaggggaccgtcccgtagacgacctctcctgtgcagtcgtcgtggtattccacctttcaagttacgtacagttcggactagtcggacctacgtcggggtcccgacccagggcctcccggaggacggaaagggcgtgggagtgggtgactaagttatagtggtatggaagtggtaaatagtacaaagttactatcgacaaggtacgtccggtaaggacgggtaccgtacgttacccgtacccgtacctacgtaagaacgacgtaaaccgtaacccgaaacgtaaccacgtcttagtactctagactaagtacgacgacgaccgtagacgacgaccgaacggaccacggtactacgtattacttcgcgtaggacgaaaggacgagacgacgtccaacgg

SEQ ID NO: 265209 - DNA, 675 bp, Homo sapiens
  misc_feature: GYAE6OF01AMCFR.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggcctgggacctcctgacgactctcctgtgcagcgtctggattcaccttcagttagtcatcggcatgcacgtcgggccncaggcctcgaggcagggctgggagtgggtgctagttatagtggtatggagtgggaaattgtacaattactagtgacctaaggtaccgtccggtaggaaacgggtccgtaagttcccgaaccccggttctaccgaaggaaccaacctaacgttaccccgaaaagaacctaccggtacttgttaacttcgtaggaacctaaacgtcgaaacccgacgtacccgtaggaaccggaccggacccggtaaacgggacccgtaaccggggtactttaaacgggttaggtttaaccgtttaccggttacgggttaccgaaccgggtaaacgggtaacgaaacccgggttaccaacccggacccggttaaacccggg

SEQ ID NO: 265210 - DNA, 804 bp, Homo sapiens
  misc_feature: GYAE6OF01CM1MF.34.26.C04.1.454.CMB.1.raw
  modified_base (185)..(185): a, c, t, g, unknown or other
  misc_feature (185)..(185): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggtttttcctcggttgcttcgttttaaaggnggtgtccaggtgtcgaggtgcagcgtgggtggagtcggtggggggagcgtggcccaggtccgtgggacctccgtgagctctctgtgcagtcgtcttggacttctaaccttgaagtacgtcagtcggactagtcgccgtaaccggtggggtccccaccgtaggccctaccggagggtaccgaaggggggtcctaggggacgggttggggacggagttaacgggtttatacgggttaggtaagttggaaagggtttacggtaaaacggttacgttaaaccaaaggtttaaacgtacgtcgggaaacctaacggttaacccggttaccgggtaacgggaacgggggtacccgtttaacgttaccccgtaccccggtttacctaacccggtaaacggtaaaccgtaacccgaaaccgttaacccccgaaaacggaacccgtaacgttaccggttacgtaaaccttacggttaacaacgtaaaaccgttaccgacccgtaacggttacccgtaacggaggtaacccggaccgggtaacgaaccgtaacgggtctttaagtaccggtttaacgttacgtacgggtactacgggaaacggtaagacgtaaccgaccgtccggtacg

SEQ ID NO: 265211 - DNA, 586 bp, Homo sapiens
  misc_feature: GYAE6OF01B8ODD.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggcccaggcctgggacgtccctgagactctcctgtgcagcgtctggattcaccttcagtagtcatggcatgcacgtgggtccnccaggctccgaggcgaaggggctgggaggtgggtggctagttatagtggtatgatgggaagtagtacaaattactatcgacaggtacctccggtaggaacgggtccgtaagttccgacccgttctaccgagacgaacaactacccgaaacgaacacgtctagtactcgtagaacaacgtcgaacctacgaccgtaggacgacgtaccggaaggacccgacgggtacttacgttagttaacttacgtgtacgacgaggacgaacgacgacgacccgtacgg

SEQ ID NO: 265212 - DNA, 584 bp, Homo sapiens
  misc_feature: GYAE6OF01BLPLG.34.26.C04.1.454.CMB.1.raw
  modified_base (178)..(178): a, c, t, g, unknown or other
  misc_feature (178)..(178): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
  modified_base (559)..(559): a, c, t, g, unknown or other
  misc_feature (559)..(559): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgcgtagctctttaagaggtntcagtgtcaggtgcagcgtggtggagtcgtgggggacgcgtggacccaggcccgtgggccttcccgagaacgtacctctccgtggtcgacgagtcgtcgtggacttcaaccttnagttgcagtggcagtgcacgtcgggccncgaggtcacgaggacaagggctggagtggtagcgtagtntagtggtacngagtggacttagntaaatgtnacgngaagtcgtcggagtacggctagttccacgttcncgagatacanacgagacncgntgtatnaccgtagaaancgtaaccgtagccaaggganacccggttacggaaccgttacgcgtaaccgtagttggaaatttcgacggtacggaaccggtaagacggttaaanccccggtaaaagttccccgtaaggg

SEQ ID NO: 265213 - DNA, 529 bp, Homo sapiens
  misc_feature: GYAE6OF01A69U8.34.26.C04.1.454.CMB.1.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggcccagcctgggacgtcccnganacctctcctgtgcagcgtctggattccaccttcagtagtcatggcatgccacgtcgggtcccncgaggcctccgaggcgaaggggctgggaggtgggngcagttanagtgtatgagtggaagtagacaatactagtgacagtacctcgtgaagggctactctaccgtcncgaganacaataccgaacgaaccncnctgtanctgactaatcgaccagcagacgacgacggacgaccgacgtctagtggtactcgagtgacgagacgaagacgngtccgtacg

SEQ ID NO: 265214 - DNA, 788 bp, Homo sapiens
  misc_feature: GYAE6OF01DALAC.34.26.C04.1.454.CMB.1.raw
  modified_base (649)..(649): a, c, t, g, unknown or other
  misc_feature (649)..(649): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggagcggtggccccaggcccgtggggacctccctgacgtaccttcctccgtggtcgccgaggtccgttcgttggtaactttccaaccctttcgaagttagtcagttcggacagtcgcacggttcggggtccccacgacggcctccggaggccggaaaggggcgtagggaggtggggtggactaagtttagtacggttggtaatggtaacgttagggtaaagttacgttaaccaaagtttacgtagttacggaccgtaaggtacccgttaccgggtagggaaaccgggtccccgtttaagtttacccccgaaccccggtttccgtaaccgaaacggtaaccgaaccgtaaaaccctaacccccggaaaaagaccccgtaacggttaccttacggtttaacctcgtaaacgaacctaaacgtaccgaacccgnggtacccgtaggaacgggtaccgaaccccggaagggtaaacccctacggtaacgtttaacgttacggtttaaactttccgggagggtacggaacggtaaacggaaacaaccgggtaacccaccgggtacccttaacggg

SEQ ID NO: 265215 - DNA, 729 bp, Homo sapiens
  misc_feature: GYAE6OF01CW687.34.26.C04.1.454.CMB.1.raw
  modified_base (178)..(178): a, c, t, g, unknown or other
  misc_feature (178)..(178): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgcttcttttaagnggtgtccagtgtcaggtgcagcgtggtggagtcgtgggggagcgtggcccagccgtgggactccctgacgtctctcctgtgcagcgtctggacttcaccttnaggtatcagtggcagtgcacgtcgggtccnccaggcctaccgaggcgaaggggctagggagtcggggtgactagttagtagtcggtaangtaagtggtaaagtgtacgaatctaagtgacaggtacgtccggtaggaacgggtccgtaacgttaccgaacccggttctaccgaaacggaacgtaaccgaaaccgttaccccgaaaacggaaacccgtaccggtaacgtttaaggtaaccgttaccgttaacggaaaccgttaaaacgtacccggtaaacccgaacggtaccccgttaagggaacgggtaacccggtaacccgggaaaccgggaacccggtaaccgggtaaccgttaaagttacggtttaaaccgtttacggttaacgggtgggtaacccggtaagggaaaccggtaacggaaccgttaaaccgggcccgttaaaccggg

SEQ ID NO: 265216 - DNA, 703 bp, Homo sapiens
  misc_feature: GYAE6OF01EEU0C.34.26.C04.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagcttgggttttcctcgttgcttcgttttaagaggtgtccagtgtcgaggtncagcgtggtggagtcgtgggggagcgtggcccaggccgtgggacctccgngacgctctccgtgtcgctagcgtctggacttccaccttcgagtagtcagtcggcatcgcgtacgtcgggtccgccgtaggcctccggagggaccgtaaggggtccgtagggtacgggttacggggtgtacgtaaggtttaagttaggtaggttacgtggtaacgttagggtaaacgttagtactaaacgttacgtagtcgacgtacgtaccgtacgtaggaacggtccgtacgttaccgtaccgtcaccgaagacgtaacaaccgtacccgaaacgaccgacgtcttagtacgtactacgaactaacgtccgaacctacggtaccgtaacgaacggtaccggaccggaacggtacccgtaacggttacgttaagttacggttaacgttcggttacggtaacggaaccggttaacggaacggtaaccgaaccggtacggtaccccgttaaccggg

SEQ ID NO: 265217 - DNA, 845 bp, Homo sapiens
  misc_feature: GYAE6OF01DKXSK.34.26.C04.1.454.CMB.1.raw
  modified_base (285)..(285): a, c, t, g, unknown or other
  misc_feature (285)..(285): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtgggagtttgggctgagcgttgggttttcctcgttgcttcttttaaaggaggtgtccagtgtcaggtgcagcgtgggtggagtcggtgggggaggcgtcggccccaggcccgtggggaccgttcccctggacgtaccttccgtcctgggtcncgtagccgttcgtgggtactttcctaacccctttgaaggttacgttaccgagttcgggacctagttcggcccgtaaccggttccgggggccccgcccgtacgggtccctacccgggaaggggacccgggtaaagggggtccgtagggggtacgggttcggggtacggtaccgttaaggtttacgttaagggtggttaacgtaggtacggtaggtaagttaacgttacgaaattacgaagtgaccgtaaggttacccgtaccgggttaaggaacccggggtaccgtaacttaccccgaacccgttccgtaacccgaacgtaacggaacccctaaccgtaaccccgaaacgtaacccgaaccgttacgtaccgtttacgttaaccggtaacaaccggttaaaacgtaccgtaaccccgacgggttaaccctagggaaccggacccggaaccccggtaacgggaccgtaaacggtacgttaaacgttacgttaacgtttaccgggtagacccgggtaacgggaaacggaacgtaagaaccggtaaccgtaccccgtaaccggg

SEQ ID NO: 265218 - DNA, 600 bp, Homo sapiens
  misc_feature: GYAE6OF01BPSQY.34.26.C04.1.454.CMB.1.raw
  modified_base (249)..(249): a, c, t, g, unknown or other
  misc_feature (249)..(249): n is a, c, g, or t
tcagtacacgtgatcacgaccggtgctcgatttagtctagcgactttgggtttggggctgggagaggagccccagcactagaggtcggcggtgtttccattcggtgatcagcactgaacacagaggactcaccatggagtttgggctgagcttgggttttcctcgttgcttcttttaagaggttgtccagtgtcaggtgcagcgtggtggagtcgtgggggagcgtggcccagccgtgggaccgtcccngacgctctcctgtgcagcgtctggtacttcaccttcagtgtcatggcatgcctacgtcgggtcccgcaggcctccgaggccgaaggggctgggaggtgggcgctaggttacgtagtggtatgtagtaggtaagtagtacaaattgtagtgactaacgtacgtccggtaggacggaccgtacttcccgtaccgtcctaccgagtacgaacaacctacccgaagaaccacgcttacgtatcgtagaaccaatccgtaaccgacgtacgtacgaggtaccgaccggtaacggccgaacgtcgtagttacgttaaggttcagggtccgaagtacggaagacgacgcgtccgtacg

SEQ ID NO: 265219 - DNA, 787 bp, Homo sapiens
  misc_feature: GYAE6OF01D23PO.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttgggctgagtcgttgggtttttcctcgtttgcttacgttttaaaggaggttgtccagtgtcgaggtgcagcgtgggtggaggtcggtgggggaggcggtcggccccgaggcccgtggggaccgtcccgtaggacgtccttcctcctggtcgcgagtccgtcgtggactttcctaccttcgagttagtcagttggcctagtcgccgtaccggtcggggtccccgccgacggccctaccggagggacgaaggggcgtagggaggtggggtcgacgttaaggttagtacggttaggttagtggtagttaggaaagttagtaactaaagttacgtagtcgactaacggtaccgtaccggtaggaaccgggtccgttacttaccgtaccccgttccgtaacgaacgtaacgaaccctaaaccgttaccccgaaacgaaaccgtaccggtcgttacgttaacgttcgtaacgaaaccgtaacgtaaccggtaacccgtaacggtacccgttaacgggaccggaaaccgggtacccgggaaacggtaaaccccggtaacggtaccgtttaacggtttaggttaacgtttaccggttggggtaccgaacgggtaacgggaacgtaacggaacccggtaaccgtacccgtaaccgg

SEQ ID NO: 265220 - DNA, 728 bp, Homo sapiens
  misc_feature: GYAE6OF01BOI7V.34.26.C04.1.454.CMB.1.raw
  modified_base (127)..(127): a, c, t, g, unknown or other
  misc_feature (127)..(127): n is a, c, g, or t
  modified_base (169)..(169): a, c, t, g, unknown or other
  misc_feature (169)..(169): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (677)..(677): a, c, t, g, unknown or other
  misc_feature (677)..(677): n is a, c, g, or t
  modified_base (685)..(685): a, c, t, g, unknown or other
  misc_feature (685)..(685): n is a, c, g, or t
tcagtacacgtgatcacgaccggtgctcgatttagtctagcgactttgggttgggggctgggagacggagcccaggcactagaggtcggcggtgtttccattcgggtcgatcagcactggaactacngaggctcaccagtcggagttgggctgagcttgggttttcccngttgccttattttaagnggtctccagtntcgaggtnactgtcgnggtgagtcgtgggggancgtagccagtccgtgggaccttccnggacgacctcgttccgtaggtcgaccttaggcgttacgtaggtacctttaccgtaccgttacgaaggttacgttacccgaaggtacgggtacctacgtcggaaccgttcggttccggggtaccctacggaccggttccctaacggacgggtaccgaacggggttcctaggggtaaccgggttacgggccggtacctttaaggttaacggtacggttacgggttaagtcgtaaggttacgggtaattcgggtaacttaacgtactagttaccgactacggttaccgtacggtaacgggtaacgtccgtacgttccgtacctcgtacacggtacaccgtaactaccgaaagtccacgttctacgttacctggtacacgtaagtcgaactcggtacgtacgagaccggtacggacgcgtacggtntacggtanaccgttagacgtcggactagggtacgacacgcccgataccggg

SEQ ID NO: 265221 - DNA, 778 bp, Homo sapiens
  misc_feature: GYAE6OF01BXSXG.34.26.C04.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtntccagtgtcaggtgcagcgtggtggagtcgtgggtgaggcggtcggcccagccgtgggaccgtccctgacgactctcctgtgcgagtcgttctggtacttcctaccttcagtacgtcagtggctagtcgccgtacgtcgggtccgccgaggtacctccgagggcggaagggtcgtaggggtaggttggggtcgacgtaggttagtaggttaggtacgttaggtaggtaacgggtaaagttacggttaactaaattaacgttagttacggacctaacggtaccgttaccgggtagggaaccgggtcccgttaacgttaccccgtacccggttacccgtacccgtaacggtaacgtaaacccgtaaacccgtaacccccgtaaaacgtaacccggaacccggtttaccgttacgttaacgttacccgtaacgaaaccgtaaaccgggttaccgaaaccgttacccggaccgttaacgggaaaccgtacgggaaccccggtaaaccggaaccggttacccggtacgttacgttaccggttacgttacccgttagggtacgaacgggaagtacggaaccggttaacgacccggtacccgg

SEQ ID NO: 265222 - DNA, 597 bp, Homo sapiens
  misc_feature: GYAE6OF01ASROP.34.26.C04.1.454.CMB.1.raw
  modified_base (324)..(324): a, c, t, g, unknown or other
  misc_feature (324)..(324): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggttgtccagtgtcaggtgcagctgggtggagtcgtgggggaggcgtggcccaggccgtggggaccgtccctgacgtactctccgtgtgcagcgtcgtggactttccaccttcaggttagtcagtggcatcgcacgtcgggtcccnccgaggctccgaggcgaaggggctgggaggtggggtgctaggttatgtggtatggatgggtaatagtacaaatctangacagtctcggngaacggctattccaccgtcacgagacgacaacctacccaagaacncgtctatactcganaacaaacgtcgaaccacgcctacggacgaccggaccggaacggaccgtaccggtacgttaagttaggttaacttacggtggtaggaacggtaaggacggaaacgaccgaaccggtcccgtaacgg

SEQ ID NO: 265223 - DNA, 584 bp, Homo sapiens
  misc_feature: GYAE6OF01B6BPY.34.26.C04.1.454.CMB.1.raw
  modified_base (307)..(307): a, c, t, g, unknown or other
  misc_feature (307)..(307): n is a, c, g, or t
  modified_base (552)..(552): a, c, t, g, unknown or other
  misc_feature (552)..(552): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttcttttaagaggtgtccagtgtcaggtgcagcgtgggtggagtcgtgggggagcgtggcccagccgtgggactcctgagactctcctgtgcagcgtctggattcaccttcagtagtcagtggcatcgcacgtgggtcccnccaggcctcccgaagggccgaaagggggctggggtacggtggggtggctagtttaagtagtgggtatgagtagggaaacttgtacaaattactaatgacagtaccgtcgtaggaacggccgtattccgaccgtctacgaagacgaacaactacccaaagaaccacgtactgtactacgtgaactaaagtcgaaccagaccgtaggacgacgccggaacgaccgacggtactagtagtactttcgnggtacgacggtaacgaagagacacgcgtaacg

SEQ ID NO: 265224 - DNA, 812 bp, Homo sapiens
  misc_feature: GYAE6OF01CYZ3T.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagaggttgtccagtgtcaggtgcagctggtggagtcgtgggggagcgtggcccagccctggggactccctgagacctctcctgtgcagtccgtctaggtacttcctaccgttcaaggttacgtcaagttcgggctaattcggccgtacgtttcgggggaccccaccgtaagggtcccttacccggaagggtccggaaaacggggggtcttagggggaaggttgggggtcgaccttaaaggttttagaggtttggggtaaattcggtaacggtagggtaaaacggttagtaaccaaagtttaacgtaagttcggaaccgttaacgggtaccttacccgggtagggtaaccggggtcccttaagtttccccggaacccggttcctaaacccgaaggggtaacctaaaccccgtaaacgtttacccccgaaaaagtaacccgtaccggttaccgtttagggtaaccttaccgtaaggaaccttaaaacgtcggaaacccgtacgttcccggaaggaccggtaaccggtaaccgggaacgggaaacctacgggtactttaaaacgtcggtttaaactttcggtcggtaaggaaccggtaaggaacggtaacgtaacccgacggttaaccccgtaacggg

SEQ ID NO: 265225 - DNA, 720 bp, Homo sapiens
  misc_feature: GYAE6OF01BTW65.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggcccagccgtgggaccgtccctgacgctctcctggtgcagcgtctggacttccaccttcagtagtcagtggcagtcgcacgttcgggtcccgcacgggcctccgagggacgaacgggggctaggggaggtggggtcgcgtaaggtttatagtcggtatcggtagtagggtaaagttagtacaaaagttacgtagtcggacgtagacccgttaccggtagggaaccgggccgttactttacccgacccgttcctacccgaaaggaaccgtaaccaaaccgtaaccccgaaaacgtaacccgaccgtcgttaacgtacttaccgtacgaacctaaagtaccggaaccgtaacggtcccgtaaggaccggtaacgggaccccggaaagggtacccgtaaccgggtacgtttaaacgttacggtttaaacgtttccggtaggttaccgggaacggtaacgggaacggttaaaggaaacccgccgacccggttaaaccccg

SEQ ID NO: 265226 - DNA, 650 bp, Homo sapiens
  misc_feature: GYAE6OF01D8DDV.34.26.C04.1.454.CMB.1.raw
  modified_base (184)..(184): a, c, t, g, unknown or other
  misc_feature (184)..(184): n is a, c, g, or t
  modified_base (333)..(333): a, c, t, g, unknown or other
  misc_feature (333)..(333): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatgggagtttgggctgagtcttggggttttccctcgttgcttcttttaaagnggtgtccagtgtcaggtgcagctggtggagtcgtgggggagcgtggcccagcctgggacctccctgacgtacctctcctggtgccaggcgttctggtacttccaccttcgaagtacgtccagtcggcagttgcctacgtcggggtcccnccgaggcctaccgagggcgaaggggctgggagtggggtgcgtagttatagtaggtatgagtggtaaagtagtacaaattacgtatacggacacgtaccgtcgtacggaacgggccgtacttcgtacccgtcgtacacgaacgaaccaacgtaacccaagtaaccacgtcgttagtactacgtacgaactaaacgtacgaaccgtaaccggtcctagggtaaccggtaacggacccgggtaaggacccgtaacggttactagttacggtacttaccgtaggtcgaggtaacgaacggagaacgaccgtccgtaaccgg

SEQ ID NO: 265227 - DNA, 585 bp, Homo sapiens
  misc_feature: GYAE6OF01CLJ0T.34.26.C04.1.454.CMB.1.raw
  modified_base (180)..(180): a, c, t, g, unknown or other
  misc_feature (180)..(180): n is a, c, g, or t
  modified_base (340)..(340): a, c, t, g, unknown or other
  misc_feature (340)..(340): n is a, c, g, or t
tcagtacacgtgatcacgaccggtgctcgatttagtctagcgactttgggtttgggggctggggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggcccagcctgggactccctgacgtactctcctgtgcagcgtctggattcaccttcagtagtcatggcatgcacgtgggtcccgcaggcctcgaggcgaaggggctgggagtgggngctagttatatggtatgatggaagtgtacaattactagtcgactaagtaccgtccggtaggaacgggtccgtagttccgaccgtctaccgaagacgaacaactaccccgaaagaaccacgtctagtactacgtagacaaacgtcgaccagaccgtagacgacgaccggaacggacgacggtacgtaagtagttaagttaccgtaggtacgacggtaacggaagaagaaccgacgtcccgtaacgg

SEQ ID NO: 265228 - DNA, 894 bp, Homo sapiens
  misc_feature: GYAE6OF01ACLY9.34.26.C04.1.454.CMB.1.raw
  modified_base (247)..(247): a, c, t, g, unknown or other
  misc_feature (247)..(247): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggacgcgtggcccaggcctgggacctcccngacgactctcctgtcgcaggcgttctggtacttccacctttcgaggttacgtcagtcggactagtcggcctacggtccgggtcccaccgagggtcctacccgaaggggaccggtaaggggggccttagggggtaacgggtttcgggggtacggtaccgttaaggtttttaaacgtagggtttaggggttaaacgttagggtaaggtttacggggtaaaaggtttacgttaaccgaaaacgttttaccgttaaggttacggaccgttaaccggtacccggttacccgggttaacgggaaaccggggtaccccgtttaacgtttaccccggtaacccccggttaccgtttaaccccggaaacggttaaaccggaaaccccttaaacccggtaaacccccgaaaacggtaaacccgtacccgtacgtttaacgttaaccgttacgttaaccgaaaccgttaaaccgtaccgggtaaacccgaccggtaccgttaggggaaccgtaaccgggtaacccggtacgggaacccggtaaccgggttacgtttaaaccggttacgggtttaaacgttacccggttagggttaacccggtacgggtaaaccgggtaaggaacccggtaaccgaaccggtccccgttaaacccgggg

SEQ ID NO: 265229 - DNA, 750 bp, Homo sapiens
  misc_feature: GYAE6OF01AJGWV.34.26.C04.1.454.CMB.1.raw
  modified_base (177)..(177): a, c, t, g, unknown or other
  misc_feature (177)..(177): n is a, c, g, or t
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttcttttaagnggtgtccagtgtcaggtgcagctggtggagtcgtgggggagcgtggcccagccgtgggactcccngagctctcctgtgcagcgtctggacttcaccttnagtagtcagtcggctagtcgcctacgtcggggtcccnccagggcctaccgagggtaccggaaaggggggtcctagggggacggttggggggtcgtaccgtaaggttttaacgagttggggtaataggtaagttagggtaaaggtagtaccaaattacgtagtgaccgtaaggtacccggttccggtaagggtaaccgggtccgttaacgttcccgaacccgttccgtacccgaagtaacggaacctaaaccgttaacccccggaaaagtaacccgaccggtacgttcggtaaaccttccgtaacggtaacctaaaacgttaccggaacccctaaccggttaccgtagggaaccgaaccggaccgggaaccggaacccgtaccgggtaaccttacgttacggttaaactttaccggtagggtaacggaccggtaaagggaacaacgggtaacctaaaccgggcccgtaaacccgg

SEQ ID NO: 265230 - DNA, 792 bp, Homo sapiens
  misc_feature: GYAE6OF01D3PBI.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggttttcctcgttgcttacttttaagaggtcgtccagtgtcgaggtgcagtcgtggtggagtcggtggggagcgtcggcccaggccgtgggaccgttcccgtgacgtacctccgtccgtggtacgcgtacggtcgttcgtaggtacttacctacctttggagtacgtctagtcggactagtcgacgtaccggttccgggtcccgaccgacggtcccgtaccggagggtaaccgtaaggggtcggtagggtaggttggggtacgtacgttaagttaagttaggtaggtaacgtaggtaaggttaggtaaaacggttacgtaacgtaaacgtaaccgtttagaccggtaaccgtaaccgggtaccttaacggggtaacggtaaccgggtccctttaaccgtttacccggccccgttaaacgtacccgaaagtaaaccctaaccgtaaacccttaaccccgaaagttaacccgtaacggttcctaaaggttacgttaacgaacgtaaacgtaaccggtacgaacccgaggttaccgaacggaggaacccgacggaaacgtccggaagttacgttaaccgtgtttaacgtcgggacgttaggaaccgtaggacgaacccgaactccgggaattacccggg

SEQ ID NO: 265231 - DNA, 710 bp, Homo sapiens
  misc_feature: GYAE6OF01ALMS7.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgcttcgttttaagaggtgtccagtgtcaggtgcagcgtggtggagtcgtggggacgcgtcgcccgagtccgtgggacgtcccgtgaacgtctcgtaccgtgtcgcgacggtcgttcgtaggtactttccaaccgtttcgaaggttcgtaccgtagtcggctagtcgcgtacgtcgggtcccaccgaggcctaccggaggaccggtaagggtcttggggacgttcggggtagtaccgtaaggtttactaggtagggttaagcggtaaggtacggtaaagttacgtaacctaacgttacgtacgtacggactaacggtacccgttacgggtaacggaaacgggtcgtaacgtttacccgtaaccgtcgtaacgaagtacgaacctaacgtaccgaagtaccgacgtcgtaacgtacgtacgtaacgaacgtaagtccgtaaccgtacgtaccgtaggacgaaccggacggaacgacccggtagtacgttacgtacgttagttacgcggtacgaacgtacgtaacgacgtaccgacgttccgtaacgg

SEQ ID NO: 265232 - DNA, 647 bp, Homo sapiens
  misc_feature: GYAE6OF01CODUL.34.26.C04.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggaccgtcccngacgctctcctgtgcagcgtcgtggattcaccttnagtagtcatggcatgctacgtcgggtccgccgaggcctccgagggtcgaaagggggtctgggaggtggggtacggctaggtttatagtcggttaatggaagtcgggtaaagtagtacaaacgttacgtaagtcgacgaacgtaccgtaccggtaggaacgggtaccgtacgttacccgacccgtcgtaccgagaaccgaacctaacgtacccgaaagaaccgacgtctagttactacgtacgaacaacgtacgaccacggtaccgtaggacggtaccggaccgggaccgaccggacggtacttacgtagttaacgttacgtcggtacggtacggaaggtaggaacgaccgacgtcccgtaaccggg

SEQ ID NO: 265233 - DNA, 672 bp, Homo sapiens
  misc_feature: GYAE6OF01BW0SY.34.26.C04.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (557)..(557): a, c, t, g, unknown or other
  misc_feature (557)..(557): n is a, c, g, or t
  modified_base (618)..(618): a, c, t, g, unknown or other
  misc_feature (618)..(618): n is a, c, g, or t
tcagtacacgtgatcacgaccggtgctcgatttagtctagcgactttgggtttggggctgggagaggagcccagcactagaggtcggcggtgtttccattcggtgatcagcactgaacacagacggactcaccagtggagttggctgagcgtggtttcctgtgctctttaagaggtgtccgagtgtcgaggtgcgagcgtgggtggaggtcggtgggggacgcggtcggcccgaggtcccgtcggggaccgttccctggtacgtccttcgtccgtggtgacgtggtcgtcgttaggtacttcctaactttcgaaggtacgtcagtcggacntccgactccggttcggacccnccgaggtcctacggacggacggaacgggcgtagggngggtgggtacgtagtagttagtagtaggtatagtaggtaaggtaagtacgtactaaacgttacagttacgactacgtaaccggttccggaagggtaccgggtaccttacgttaccccgtaacgtccgtaacggaacggtaacaacgaacccgtaaccgaaaggtaaccngttacgtagtaccttaacacggtaacacgtacgaccctagccgtagacacggtcgaaacgngtaccgatgttagtacgtagcgtagacgtaaggaccgagtcaccggtcgtacgg

SEQ ID NO: 265234 - DNA, 770 bp, Homo sapiens
  misc_feature: GYAE6OF01AJ65P.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggaccgtcccgtgagtacctcctccgtgtgcaggccgttcgtggtactttccaccttcgaagttagtcagtggcctatcggaccaccggttcggggtccccgccgaggtccctaccggacgggtcgaagggggtcctggggaaggttggggtgacgttaggtttaacgtaggtagggtaatgggtaagttacgggtaaaggttacgtaacgtaaagttacttaaggtcgaccgtaaggtaccgttacccgggtagggaaaccggggtcccttaagtttccccgaaccccgttccgtaacccgtaacggaacgtaaacccgtaacctaacccccgaaagtaaacccgaccggttacctacgttaacttaccgacgtaaaccgtaacgttaccggaacccgaaccggtaccgtaagggacgaacccgggtacccgggaacggaaacccggtacggtaactttacggttcgtttaaacgttaccggttggttaccgggacgtaacggaacggaacgtaacccgacgtacccgtaaccgg

SEQ ID NO: 265235 - DNA, 730 bp, Homo sapiens
  misc_feature: GYAE6OF01A7HVE.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgttggggacctccctggacgaccttcctccgtaggtgaccgagtccgttcgtggtacttccacctttcgagttacgtcagtcggcagttcgacctacgttcggggtcccgccgaggtcctaccgagggacgaaggggctagggaggttggggtgcgtagttagtagtggtatcggagtagggaaagttacgtactaaagttactagtacgaccgtaagtaccgtccgggtaggaaccgggtccgtaacgttccgaaccccgttcgaccgtaaacggaacgtaaccaaacgtaaccccgaaagtaaccgaccgtacttacggtacttacgtacgaacgtaaacgtaccggaaccgtacggaccttaacgggacgaaccggaacccggaacgggtaaacccgacggtaacgtttaacggttacggttaaacgtttaccggtaggttaacggaccggtaaagggtaacgaagggtaccaaccgggttcccgtaaacccggg

SEQ ID NO: 265236 - DNA, 694 bp, Homo sapiens
  misc_feature: GYAE6OF01CUF0E.34.26.C04.1.454.CMB.1.raw
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
  modified_base (432)..(432): a, c, t, g, unknown or other
  misc_feature (432)..(432): n is a, c, g, or t
tcagtacacgtgatcacgaccggtgctcgatttagtctagcgactttgggtttgggcctgggagaggagccccagcacgtagaggtcgggcggtgtttccagttccggtgatcagcactgaacacagaggacctcaccatggagtttgggctgagctggttttcctcgttgcttnttttaacgaggtntaccagtgtcaggtgcagctggttgagtcgnggggagcgtggacccgagccgtgggacctccctagacgaccttctccgtggtgaccaggccgttcgtggtaactttccaacccgtttgaagtagttccaagttggacctagtcgaccgtaccggttcgggtccccgaccgacggcccttacccgaagggccgaaagggggctaggggcggtggggtgacttaaggtttatacggttggttaancggtaagtagggtaaacgtagtacaaattaccgtagtcgacgtaacgtaccgtaccggtaaggaacggtcctaagttccgacccgtctaccgaagacgtaacaaccgtacccgaaagacccgtacgtttagactacgtagaacctaaacgtcgaacccgtagaccgtagaacgacgacggtaagaccgagtcttaagtcgttagttaccgtggtacgaaccggtagaaacggaacgttaccgaacgtcccgtaagtaccggg

SEQ ID NO: 265237 - DNA, 702 bp, Homo sapiens
  misc_feature: GYAE6OF01EVQWQ.34.26.C04.1.454.CMB.1.raw
  modified_base (377)..(377): a, c, t, g, unknown or other
  misc_feature (377)..(377): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttccctcgttgcttctttttaagaggtgtccagtgtcaggtgcagctgggtggagtcggtgggggagcgtcggcccagccgtgggacctccctggacgacctctccgtgtcgcaggcgttctggtacttccaccttcagtactcagtcggacatcgcctacggtcgggtacccgccgacggcctaccggagggacgaagggtcgtgggacggttggggngacgttagttaatagtggtatagagttaagggaaagttagtacttaaaatacgttagtcgactaacggtaccgttaccgggacggtaacgggtaccgtaaccgttacccgtaccgtaccgtaaccgaacgaaacgtaacctaaactaacccgaaaacgaccgtaacgtaccgttagtactacgtacgaaccttaaacgcgtacccgtaacgtcgtagggaaccgacgggaccggaagacccggtaacggtacttaagtaggtttaaccttacggtacggtacgaacggtaacggtaacggaaccgtaccgacggtaccctaacgg

SEQ ID NO: 265238 - DNA, 580 bp, Homo sapiens
  misc_feature: GYAE6OF01EZOYP.34.26.C04.1.454.CMB.1.raw
  modified_base (177)..(177): a, c, t, g, unknown or other
  misc_feature (177)..(177): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (568)..(568): a, c, t, g, unknown or other
  misc_feature (568)..(568): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctgggtggagtcgtgggggagcgtggcccagcctggggacctccctgacgactctcctgtcgcgagcgtctggacttccacctttcagtagtcatggcatgcacgtcgggtccgccaggcctccgagggcgaaggggctgggagtgggtgcaggtttangtgtancgagtggaaagtgtacaaatcgtatgactacggacctcggagaacgggcctagttccgaccgtcaccgagaacgaactaactacccgaaagaaccgacgtcttagtactcgtacgaaccgaagtccgaacacgtctaggacgaacggccgtaggacaccggtactagttagtaacttcgtagtacgacgtaaggaacacggaacncgcccgtaacgg

SEQ ID NO: 265239 - DNA, 807 bp, Homo sapiens
  misc_feature: GYAE6OF01AI4MA.34.26.C04.1.454.CMB.1.raw
  modified_base (195)..(195): a, c, t, g, unknown or other
  misc_feature (195)..(195): n is a, c, g, or t
tcagtacacgtgatcacgaccggtgctcgatttagtctagcgactttgggtttggggctgggagaggagcccagcgactagaggtcggcggtgtttccattcggtgatcagcactgaacacagaggactcaccagtggtaggtttgggctggagtcgtttgggtttttcctcgtttgtctttacgttttaaaggnggttgtccgaggttgtcgaggtgcgtaggcgttagggtggaggtcggtggggggagtccgtcggcccgagggtcccgtggggaccgtcccgtggaacgtccttccgtccgtggtcgacgacgtcgttcgtaggtactttcccaaccgtttgaacggttacgttccgagtcggtacctagtcggccgtaccggttcgggtccccgacgaggtccctacggacgggtacggaggggtcgtaggggtaggttagggtacggtacttaaaggtttagtaaggttagggtaaccgttaggtaaaggtttaagggtaaacgtttaactaaccgtaaaaacgtttccgttaagttccgacgtaacggttacccggttaccgggtaacggtaaccggttcccgtaacgttaccccgtaacccggttaccgaaccgtaacggaaacgaaccgtaaaccgtaacccgaaacgttaacgaccgttacgtagtaaccgttaccgtaagaaccgtaacgtacgtaaccgtacgtccgtaaggaccggtaccggaaccggtacggaacgtacggtagttacggtagttacgtagtcggagacggagtacgacgacgcgccgtacgg

SEQ ID NO: 265240 - DNA, 705 bp, Homo sapiens
  misc_feature: GYAE6OF01DP739.34.26.C04.1.454.CMB.1.raw
  modified_base (183)..(183): a, c, t, g, unknown or other
  misc_feature (183)..(183): n is a, c, g, or t
  modified_base (533)..(533): a, c, t, g, unknown or other
  misc_feature (533)..(533): n is a, c, g, or t
  modified_base (688)..(688): a, c, t, g, unknown or other
  misc_feature (688)..(688): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggaggtttgggctgagcttgggttttcctcgttgtcttcgttttaaagnggtgtcctagtgtcaggtgcagcgtgggtgggagtcggtgggggacggcggtcggccccaggtcccgtaggggaccgttccctggacgtaccttcctccgtggtcgccgagtcgttcgtgtacttcctacctttacgagttacgtcagttcggcatcggtaccgtccggttacgggtccccgcgaacggtccctaccggagggacggaaggggtcgttagggaggttggggcgtagtaagttactgtaggtaagtggagtaggaaagtactactaagtactatcgatacgcgtacggtagacggtacgtactccgacgtcagtaagacaactaacctaccaaacgtaacnccgtacgttatactgtaacgtaactaaacgtaccgaccgtacggccctaaggaccggaacgtaccgggaacgaccggtaacgtacggttaaacttagggttaacgttaccggtacgggtacgtaaacgggaaggtaaacccggacggtaaacccncgggtaacccgtacggg

SEQ ID NO: 265241 - DNA, 680 bp, Homo sapiens
  misc_feature: GYAE6OF01AVBFI.34.26.C04.1.454.CMB.1.raw
  modified_base (338)..(338): a, c, t, g, unknown or other
  misc_feature (338)..(338): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagtcttgggttttcctcgttgcttacgttttaagaggtgtccagtgtcaggtgcagctggtggagtcgtgggggagcgtcggcccaggcccgtggggaccgtccccgtgacgtacctcctccgtggtcgccaggccgttcgtggtaacttccacctttcgagttagtcagtggcatgccacgtcgggtcccncgaggcctccgaggcgaaggggctgggagtgggtcggactaggtttacagtggtaatggaagtgggaaagttgtacaaattactagtcgactaacgtccgtaccggtaggaacgggcctaacgttcccgaacccgttcctaccgaagtaaccggaacctaaacctacccgaaagtaacccgacgtacgttacgtaccgtacgtacgaacgtaaacgtccgaaccgttaccgaccttacggaacggtaccggacccggtaaccggaccgaacgggtacttacggttagttaacggttacgtaggtacgacggtaaggtacggagaaccgacggtcccgtaacg

SEQ ID NO: 265242 - DNA, 704 bp, Homo sapiens
  misc_feature: GYAE6OF01A651G.34.26.C04.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (210)..(210): a, c, t, g, unknown or other
  misc_feature (210)..(210): n is a, c, g, or t
  modified_base (669)..(669): a, c, t, g, unknown or other
  misc_feature (669)..(669): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttccngttgcttcttttaagnggtgtccagtgtcaggtgcagctgggtgagtcgngggggagcgtggcccaggcctggggactccctgacgtacctctccgtgtgcagcgtctggatttccacctttcgagttagtcagtggcaattcggcacggttcgggtccccaccgtagggcccttaccgaagggccgaaaggggggccttaggggtacggttggggttaggacttaaggttatacgttagggtattggaacgttagggtaaagttacggtactaaaagttactagacggtccctaagggtacccgttaccggttaggggaaaccgggtcccgtaacgttttacccggtaaccccgttaccgttaacccggaacggtaaccgaaccgtaaaacccgttacccgaaaacgtaaccgaccgtacgtacgttaacttccgtagaactaaggtaccgacgtacgtcgtagaacggacgacggagtacccgaaggtactagtacgttacttacgngtacgtaccggagacgacgaacctggtacctaacg

SEQ ID NO: 265243 - DNA, 805 bp, Homo sapiens
  misc_feature: GYAE6OF01DK2NU.34.26.C04.1.454.CMB.1.raw
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (795)..(795): a, c, t, g, unknown or other
  misc_feature (795)..(795): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccagtggagtttggctgagtcgtgggttttcctcgttgccttagttttaagnggtgtccagtgtcgaggtgcagcgtgggtggagtcggnggggggacgcggtacggcccgtaggccgtaggggacctcccgtaggaacgtccttccgtccgtggcgaccgaggtccgttcgtaggtaactttacctaaccttcgtaaaggttacgtaccaaggttcggacctaagtccggaacgtacccggttcggggccccacggtaacgggtccctaccggaagggtaccggaaaggggggttcctagggggtaacggttcgggggttacggaacttaaggtttaacgtaaggttaggggttaaacctggggttaaaacgttaggggtaaaaacgttgttaaaccgaaaattttccgtaaagttcggaacgtaaacggttacccgtccgggttaacgggaaacgggtacccgttaacgttacccgtaacccgttaccgtaaccgacggtaaactaacccgaaaccgtaacccgaaaacgtaacccgtacgacgttacgtaacgtacgtactaaacgaaacgttacgaaccctacgtaccgtaagaacgacgtaccggaagaaccgtacgtagtacggtaatacgtcgtggtaaccgagtacgaacgacgtacngccgtaacgg

SEQ ID NO: 265244 - DNA, 907 bp, Homo sapiens
  misc_feature: GYAE6OF01DWOMZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtgggtagtttgggctgagtcgttcgggtttttcctcggtttcgctttacgttttaaggaggttcgtccgtagtcgtcgaggtgcgagtcgtgggtacggtaggttccgggtggggggacggtccggtcggcccgacggcccggttaggggtaccgttcccgtaggaccgtaccgttccgtccgttaggtcgacgtacggtcgttacgtcggtacttccgtaccttacgtaaggttcgtaccgagtggactacgtcggaccggtcggttccggggtccgaccggcggtacccgtaccgggaacgggacgggtaacggggtcgttagggggtagggttcggggtacggtacggttaagtttaggtacggttaggtacgttaaggtacggttaaggtaaggttacgtaacgttaacgttacgtacttgggtaaaccgtacgggttaccgggttaccgggtaacgggtaccgggttaccggttaaccgttttacccgtaacccggttacgtaccgtaaacgggtaaaccctaaccggtaaacccgttaaaccgaaacccgtaaccgtaaccgttacggttaacgtttaccgtaacgtaaccgtaaacgtaaccggtaaccggtaacccgtacggtacccgaagggtaaccgggtaccgggaaccccgtaagggtaacccggttaccgggttactaacgggtttacttaaacggttcggttaggtaccgggaaacggttacgggaaccgtacggtaaaccggccggtcggtaaccggg

SEQ ID NO: 265245 - DNA, 608 bp, Homo sapiens
  misc_feature: GYAE6OF01EX034.34.26.C04.1.454.CMB.1.raw
  modified_base (281)..(281): a, c, t, g, unknown or other
  misc_feature (281)..(281): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggcccagccgtgggaccgtccctgacgactctcctgtgcagctcgtggattcaccttnagtagtcatggcatgcacgtggggtcccgccgaggcctccgagggcgaaggggcgtgggagtgggtgctagttatgtggtatgagtaggaatagtcaaatactagtgacagactccggaggaacgggccgtattcccaccgtcctaccgaagaacgactaacgtacccaaagaaccacgtctagacttcgtcgaacaaacgttcgaacctacgtaccgtagggaacgacgggacccggtaagggacccgaacggttcgttaagttacggttaactttaccgtagggtacgacggaacggaacggaacgaaccgtcggacccgtaacg

SEQ ID NO: 265246 - DNA, 614 bp, Homo sapiens
  misc_feature: GYAE6OF01BP4KC.34.26.C04.1.454.CMB.1.raw
  modified_base (179)..(179): a, c, t, g, unknown or other
  misc_feature (179)..(179): n is a, c, g, or t
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagcgtggtggagtcgtggggggagcgtggcccagcctgggacctccctgagcctctccgtgtgcagcgtctggtacttccaccttnagtagtcagtggcatgctacgtcgggtcccgccagggcctaccgaggaccgaaggggtctggggaggttgggcgtactagtttaangttcggtatggtagtacggagtatactaaatctagtacgctaggtacctacggtaggaacgggcctacttccgaccgtactacgagacgacaacgtcccaaagaccacgtacgtacgtatcgagaactaacgtcgtaaccgacgtccgtaggacgaccggtacggaacggtaccgaacggtattaacgttagtacgttacggcgtacggacggtaacggaacgaagtaacaccggtcctaccgg

SEQ ID NO: 265247 - DNA, 726 bp, Homo sapiens
  misc_feature: GYAE6OF01B8P74.34.26.C04.1.454.CMB.1.raw
  modified_base (280)..(280): a, c, t, g, unknown or other
  misc_feature (280)..(280): n is a, c, g, or t
  modified_base (708)..(708): a, c, t, g, unknown or other
  misc_feature (708)..(708): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcacagtggtagtttggctgagtcgttggttttcctcgttgcttacgttttaaagaggttgtccgagtgtcgaggtgcagtcgtggtggagtcggtgggggacgcgtcggccctagccgtgggaccgtcccgtgacgactctccgtgtcgacgngtcgttacgtggtacttcccgtacctttcgaagttacgtcgtaagtcggactagtcggaccgtcggtcccggggtccccgaccggaaggtcccgtacccggaagggaccggaacggggtggtgggtacggtgggtcgtactaggtttaatagtaggtaagtggtaagttacggtaaagttacgtaactaaattaaccgtagtacgaccgtaagtcccggtacggtaacggtaaccggccgtaaccgttcccgtacccgtccgtaaccgaagtaacgaaccgtaaacctaaccgaaacgtaaacgtccgtcgttaacgtacgtacgtaactaaccaacgtaccctaacgaccgtacgtaacgacggtaacggccggaagtaccgaagttacgttagtacgttagtacgtggacgacggtacgaacgganaaccgcgtacccggtacg

SEQ ID NO: 265248 - DNA, 650 bp, Homo sapiens
  misc_feature: GYAE6OF01A9EV7.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggcccagccctgggaccgtccctgacggtacctctcctgtcgctagcgtctggacttcaccttcagtagtcatggctatgcacgtgggtccgcaggctccgacgggcgaagggcgttgggagtcgggtggcgtaggtatagtcggtatgtagacggtaagtgtactaataacgtgtagcgtaacgtacgttcccggtaaggacgggtcctaacgttccgtaacccggttactacccggtaaggtaacgaaccgtaaccctaacccggaaaacgtaccgaaaccgtccgttacgttaacgttaccgtacggtaacctaaacgtaccgtaacccgaacgtcccgttaagacgacggtacccggaagtccgaacggtctaagtcgtagttacccgtgacggtacgaaggtacgagacacgtcctaaacgg

SEQ ID NO: 265249 - DNA, 628 bp, Homo sapiens
  misc_feature: GYAE6OF01BAWC8.34.26.C04.1.454.CMB.1.raw
  modified_base (377)..(377): a, c, t, g, unknown or other
  misc_feature (377)..(377): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagaggtgtccagtgtcaggtgcagctggtggagtcgtgggggagcgtggcccagccgtgggacctccctgagtacctctccgtgtcgcagcgttctggattccactttcaagtagtcagtcggactatcgactacggtcgggtcccgccaaggtcctaccgaggcgaaggggctgggaggtgggcgctaggttacagtggtaangtagtggaatagtactaatactagtcgcaaggtacctcggtaggaacggtccgtaagttccgaacccgtcctaaccgtagaacgaacctaacgtacccgaaagaccagtaccttagtactacgtacgaacctaaagtccgaaccaggttacccgaggacgtaaccggaccggaaggcccgtaacgtcccgtaagtgttaaacgttcgacggttagaacggtagaacgtacggaacgaccgtccggtaaccg

SEQ ID NO: 265250 - DNA, 742 bp, Homo sapiens
  misc_feature: GYAE6OF01ENTP9.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggcccagccgtgggacgtccctgagacctctcctgtgcagcgtctggattcaccttcagtagtcatgcatgcacgtcgggtccgccgaggtcctccgagggtaccgaaagggggtccttaggggacggttgggggtcggtccgtaaggtttaattagttaggggttaattgggaattaggggtaaaagtacggttaactaaaactttacgttaagttacggaccgtaacggtaccgttcccgggtacgggtaaaccggggaccggtactttacccggtaaccccggttaccgtacccgtaacggaacggaaacctaaccgtaaccccctaaacgaaacccgtacccggtaacttaggtttaactacccgtaggtaaaccgtaaacgttccgtaaacccgacggttccctaggaaccggacgggaccggaacgggtaacccgacggtaccgttaaggttacttaagtttaccgtaggtaggaaccggtaggaacggtaagacaaccggcccgtaaccgg

SEQ ID NO: 265251 - DNA, 737 bp, Homo sapiens
  misc_feature: GYAE6OF01BWKY0.34.26.C04.1.454.CMB.1.raw
  modified_base (158)..(158): a, c, t, g, unknown or other
  misc_feature (158)..(158): n is a, c, g, or t
  modified_base (177)..(177): a, c, t, g, unknown or other
  misc_feature (177)..(177): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagttggctgagcttggttttccncgttgcttacgttttaagnggtcgtccagtgtcgaggtgcagcgtgggtggagtcggtggggggacgcgtcggaccccaggtccgtacgggaccgtcccgtagacgacctcgtcctggtgacngtccgtgtggtacttccacttcgagtacgtcgngtcggactagtccgacgaccggttcgggcccgccgacggtccctacggacgggaccggttaaggggtccgtaggggacgggttggggtacgtacgttaaggttttaacgtaggttaagtagtcggtaaggttaacggtaaaggttacgaattaaacgttacgttaagcgaacctacgtaccggtacggacggaacggtccttaattacccgaccgtactaacgaagaaccgtaaccaaccgaaccgaaacgacgtaccgtagttacgttaacgtactaaccggtaactaaacggtaccggacccgaagtaccgaacggaacgaccgggtacccgaaacgggacccgttaagccgtttaagttaccgttaattacggttaggacggacggtaaacgacggaacaaccgtaacggtcctaaccgg

SEQ ID NO: 265252 - DNA, 852 bp, Homo sapiens
  misc_feature: GYAE6OF01AV85N.34.26.C04.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (796)..(796): a, c, t, g, unknown or other
  misc_feature (796)..(796): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgcttcgttttaaggnggtgtccagtgtcaggtgcagcgtggtggagtcgtgggggagcgtggcccaggcccgtggggacctcccgtgacgtacctcctccgtggtcgcacggtccgtcgtaggtaatttcccaccgtttcgaaggttacgttacagtcgggacaaggttcggaccgtaccgttcggggtccccgacccgtaagggtccctacccggaaggggtacccggaaagggggggtcccttagggggtaaacgggttcggggggttacgggaccgtttaagggtttaagttaacggttggggtttaaacgtgggtaaacgtttagggggtaaaacgtttacggtaacgtaaaacgttaaccgttacgtacggtaacccgtaaggtaaccccggttaccgggttaacggggtaaaaccgggggtaccccgttaaacgtttccccgggtaaaccccggtttacccggttaacccgtaaaacgggtaaacccggtaaacccgtaaaacccggttaaaccccgaaaaccggtaaacccgtaaccggtaccgtttaacggtaccgttacgtacgaactaacgtacgtaaccgaccgtacgtagacggtacggaccgaacgggccgaaccgtntaacgtagttaacgttcgtcggtagaccggaagcggaacggctaacggctaaccgg

SEQ ID NO: 265253 - DNA, 670 bp, Homo sapiens
  misc_feature: GYAE6OF01EP3HR.34.26.C04.1.454.CMB.1.raw
  modified_base (319)..(319): a, c, t, g, unknown or other
  misc_feature (319)..(319): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcgttttaagaggtgtccagttgtcaggtgcagcgtggtggagtcgtgggggagcgtggcccaggcccgtgggacctccctgacgcctctcctgtgcagcgtctggattccaccttcagtcgtcatggcagtcgactacgtcgggtcccncgaggcctccgagggccgaaggggctgggagtggggtgactaggtttatagtggtataggtacgtggaaagttgtataaagtactagtgacaacggtacctaccggtaaggacggaccgtattaccacccgtctaccgaagaacgaaccaacgtacccaaagaaccctacgacttacgtacttacagaaccaaagtcgtaaccaacggtcccgtaaggaacggtaccggaccggaaacggtaccgtaaaccgggtacctttaacggttaaggtttaacgtttaacggttagggtacggaaccggtaaacggaacgggttaaaggaacccgtaacggtacccgtaaacccgg

SEQ ID NO: 265254 - DNA, 742 bp, Homo sapiens
  misc_feature: GYAE6OF01CHH62.34.26.C04.1.454.CMB.1.raw
  modified_base (310)..(310): a, c, t, g, unknown or other
  misc_feature (310)..(310): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtcggcccagccgtgggaccgtcccgtgacgactcgtcctggtcgcaggtcgtcgtggtacttccaccttcgagtagtcagtcggacngtcgtacacggttcgggtcccgccgacggcctaccggagggccgaaaggggtcgtaggggaggtggggtacggacgttaggttagtaggttaggtagtaggtagtaggtaaaggtttaacgactaaagttactagtcgactaacggtccgtaccggtaggaacgggtaccctaacgttacccgaccggttactaccgtaagaacgaaccaaccgttaacccgaaacgaaccgtaaccgtcttacgtacgttacccgtagtaaaccgaaacggttacgaaccccgtaggtacccgtaacgggtaccgaacccggcccgggtaaaccgggacccgtaccggggttaacctaacggtttacggttaacttttacgggaccgggtaaggtacgggtaaaggaacgggtacgtaaaccgcggtacccggtaaacccg

SEQ ID NO: 265255 - DNA, 800 bp, Homo sapiens
  misc_feature: GYAE6OF01D13WX.34.26.C04.1.454.CMB.1.raw
  modified_base (190)..(190): a, c, t, g, unknown or other
  misc_feature (190)..(190): n is a, c, g, or t
  modified_base (759)..(759): a, c, t, g, unknown or other
  misc_feature (759)..(759): n is a, c, g, or t
tcagtacacgtgatcacgaccggtgctcgatttagtctagcgactttgggtttggggctgggagaggagcccagcactagaggtcggcggtgtttccattcggtgatcagcactagaacacagaggactcaccagtggtagtttggctggagtcgtttcgggttttcctgttcgtctttacgttttaagnggtcgtaccgtagttcgtacgtaggtcgcgaggtcgtgggtggtacggttcggggagggggcgtccggtaccggccccgtaacggtccggtacggggtacccgttcccgtaggtaacccgttccttcccgtacggttggtaccgccgttaggtccggttaggttaccgttactttccctaacgtttcggtaacgttacgtcaggtgaccgtagtcggaccgttccgggtcggggtccccaacgcggttccccgaagggacgggacgggtaacgggtcgtacggggttgggtagggtaccggtatttaggttaagtggttagggtatacggtaggtaagaacggttatacttaaacgtactgtccgtaaacggtaccgtaccggttacgggaggtaccgtcgttaccgtaccgtacccgtacgacgaacgtaacgaacctaccgtaacgaacgtaccgtacgtatacgtaacgtacgaacaacgtacgtaccgacgtacgggtacaacgggaccggaccggtaacggaccggtaacgtaccgttagtacgtttacgtacggtacgtaggnggaaccgaacgtaacgaaccggaccgtacgaccccggtaag

SEQ ID NO: 265256 - DNA, 724 bp, Homo sapiens
  misc_feature: GYAE6OF01DSWGF.34.26.C04.1.454.CMB.1.raw
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
  modified_base (439)..(439): a, c, t, g, unknown or other
  misc_feature (439)..(439): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccagtggagtttgggctgagcgttgggttttcctcgttgcttacttttaagnggttgtccagtgtcaggtncagcgtggtggagtcggtgggggagcgtcggcccagccgtgggacctcccgtggacgtcttcctcctggtcgcgagtccggtntcggtaacttcctaaccttgagttagttaccagttcggcagttcggaccgtacggttccggggtaccccncccgaacgggtccctaccggagggaccggtaagggggcctgggggtacggtggggtcggacttaaggttataggttgggttaanacggtaagtaagggtaagttagaactaagtacgtagcgacgtacggtaccgtacggtaggaaccggtcgtacgtacctacccgtctacgagaaacgaccaaaccgtaccgaaacgaccgtacgtcgttagtaacgtcgtaagtaacctaaagtcccggtaaacctaccggtaccgtaaggaaccgaccgggtaaccggaacggtaaccgagggttacttacggtagttaaccggtttagcgggtaacgacgtaagggagaaccgtaacggcgtaacccgtaacgg

SEQ ID NO: 265257 - DNA, 742 bp, Homo sapiens
  misc_feature: GYAE6OF01EPIJ5.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttcttttaaggnggtgtccagtgtcaggtgcagcgtggtggagtcggtgggggagcggtcggcccgagccgtgggacctccctggacgtacctccgtccgtggtcgcgtaggtccgttcgtaggtacttttcccgaccctttcgaagttacgtcagtcggctagttcgaccgtaccggttcgggtcccgccgaggtccctaccggacgggacgaaggggtctagggggaggttgggggtagacgttaagtttataggttaggtataggaagttaggggtaaagttacgtaactaaagttacctagtcgacgtaacggtaccgttccgggtaggtaacccgggtccgttaacgttacccgtacccgttaccgtaccgaaaggaaccgaaccctaaaccgtaaccccgaaacggtaacccgtaccgttacgttacgtacttaccgaacggtaaacaacggtcccgaaccgtaccgacgtagaccgggaccggacgggaaccggtaccgtaacggtactaggttacgttaagttaccggtgtaggacgtaagacgaacgaccgtacgcccgtacgg

SEQ ID NO: 265258 - DNA, 639 bp, Homo sapiens
  misc_feature: GYAE6OF01BK7XV.34.26.C04.1.454.CMB.1.raw
  modified_base (177)..(177): a, c, t, g, unknown or other
  misc_feature (177)..(177): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaagnggtgtccagtgtcaggtgcagcgtggtggaggtcgtgggggagcgtcggcccaggcccgtgggacctccctggacgtactctccgtgtcgcagtccgtctggactttccgaccttnaaggtagtcagtggcagtcgacacggttcgggtcccnccgtagggcctccgagggcgaaggggctagggaggtgggtgctaggttatgtggtatcggagttacggaagttagtacaaattacgtagtcgactacgtacgtccggtaggaacgggccgtattacccgaccggtctaccgagaacgactaacgtaaccgtaaacgaccacgtcttagtactacgtaagacctaaagtcgaacccgtagcccgtaggaacgtacgacccggaagaccgaacggtactaagttagtaacgtttccgaggtccggaacgtaacgacggtaacacgaccgtaccgtaaccgg

SEQ ID NO: 265259 - DNA, 744 bp, Homo sapiens
  misc_feature: GYAE6OF01EM9JF.34.26.C04.1.454.CMB.1.raw
  modified_base (189)..(189): a, c, t, g, unknown or other
  misc_feature (189)..(189): n is a, c, g, or t
  modified_base (345)..(345): a, c, t, g, unknown or other
  misc_feature (345)..(345): n is a, c, g, or t
  modified_base (616)..(616): a, c, t, g, unknown or other
  misc_feature (616)..(616): n is a, c, g, or t
  modified_base (639)..(639): a, c, t, g, unknown or other
  misc_feature (639)..(639): n is a, c, g, or t
  modified_base (731)..(731): a, c, t, g, unknown or other
  misc_feature (731)..(731): n is a, c, g, or t
tcagtacacgtgatcacgaccggtgctcgatttagtctagcgactttgggtttggggctgggagaggagcccagcactagaggtcggcggttgtttccagttcggtgatcaagcactgaacacagaggactcaccagtggtagtttggctgagtcgttgggttttcctcgttgctttacgttttaaggnggttgtccgagttgtacgaggtcgcgaggtcgttgggtggaggttcggtgggggacgccgtacggcccgaggtcccgtgggacccgttccgagacgtcctccgtccgtgtacgcgtcgtcgtcgtagtacttcctaccttgagtcgtcgagtcggntacgtcgaccgtcggttccggcccgtacgcggtaccctaccggagggtaccggtaggggtccggtaagggtggggtcgggtacggttaaccgttaggtttaacgtaggttagggttaagtaggtaaccggtaaggttaaacggtactaacgttaaactacgtatacggacgtaacgttaccgttacggacggtaacgggtccttacgttacccgccgttacctaacggacgaaccgtaacaacccgtaccgaaacgtaccgcgtagttacnctaacgataacaagtccgaaccnggtactaagggaccgtacgaccgggaacgtaccgtaagttcgtaccgttaggttacgttcgtagacccggaagtaccggaagtaccgtaacncggtacctacggg

SEQ ID NO: 265260 - DNA, 839 bp, Homo sapiens
  misc_feature: GYAE6OF01A0H2P.34.26.C04.1.454.CMB.1.raw
  modified_base (183)..(183): a, c, t, g, unknown or other
  misc_feature (183)..(183): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggttttcctcgttgcttcgtttttaagnggtgtccagtgtcgaggtgcagcgtggtggagtcggtgggggaggcgtcggcccaggcccgtgggaccgttcccgtggacgtaccttcgtccttggtgcgagtccgttcgtggtaactttcccacctttcgaagttacgtcagtggctaagtcggcgtacggttcgggtccctaccgacggtcctacccggagggaccggaaagggggtccttaggggtagggttcggggttaggacgttaaaggtttaagtaggttagggtataggtaaggttagggtaaagtttaacgtaacgtaaattaaccgttaatcggaccgtaacggttaacccgttccgggtaacggaaaccgggttccgtaacggtttcccgtaacccccggttaccgttaccgaaaacggtaaccgtaaaccctaaacccgtaaccccgaaaacggtaaccctaacggtaccgtttaacggtaacgtttacggtaacgtaacccgtaaaagttacccggaacccgtaaaccggttacgtacggaaacgggaccggaccccggaaagggtaaaccccgaacggttaccgtttaaagttcggtttaaaccgttacgttgggtaaccggttacggaaacggtaaccgggaacgaacccggtaacgtacccgtaaacggg

SEQ ID NO: 265261 - DNA, 673 bp, Homo sapiens
  misc_feature: GYAE6OF01DNTCU.34.26.C04.1.454.CMB.1.raw
  modified_base (470)..(470): a, c, t, g, unknown or other
  misc_feature (470)..(470): n is a, c, g, or t
  modified_base (634)..(634): a, c, t, g, unknown or other
  misc_feature (634)..(634): n is a, c, g, or t
tcagtacacgtgatcacgaccggtgctcgatttagtctagcgactttggggtttggggctgggagaggagcccagcactagaggtcggcggtgtttccattcggtgatcagcactgaacacagaggactcaccagtggagtttgggctgagcgttgggtttttcctcgttgcttcgttttaagaggttgtccagtgtcgaggtgcagcgtgggtggacgtcggtagggggggacgccggtcggccccgaaggtcccgtggggacccttcccgtggacgtacctcgtccgtggtcgaccgtagtccgttcgtaggtactttaccgtaaccctttgaaggttacgtaccagtggacagttcgaccgtacggtcggggtcccacgtagggccctacggaggaccggaagggtcgtagggacgggtgggtgactagttataggtgtagtgagtaggtaatagtacaagtactangacaggtaccgtcggagacggccgtatccgaccgttacacgtaagaacgaactaaacgtaacccgaaggaacacgtcgttagtaactacgtagaactaactacggaaccctaaggccgtagacggacgaccggaacgacgaacggttctaagttagtattacgngtaacgacgtaacggacgtaacgcgaaccgtctaaccgg

SEQ ID NO: 265262 - DNA, 759 bp, Homo sapiens
  misc_feature: GYAE6OF01CV7OR.34.26.C04.1.454.CMB.1.raw
  modified_base (188)..(188): a, c, t, g, unknown or other
  misc_feature (188)..(188): n is a, c, g, or t
  modified_base (273)..(273): a, c, t, g, unknown or other
  misc_feature (273)..(273): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttcgggtttttcctcgtttgtccttcgttttaaaggnggtgtccgagttgtcgaggtgcaggcgtagggtggaggttcggtaggggggagtcggtcggcccgaggccgtggggaccgtcccnggtacgtaccttcctccgtgtcgtccgagtccgttcgacggtacttcctacccgttagtacgttacgtaccaggtggctagtcgccgtaccgtcgggtcccgccggacgccgtccgagggacgtaaggggcgtagggaggtgggtaggctaaggttagtacgtgtaggtacgagtaggtaagtagtactaaattacgagtcgactaggtacgtaccggtaggaaccggtcgttaactccgtaccgttaccgtaaccgaaggtaaccgacgtaaccccgtaaccgaaacctaaccgaccgttactaaccgttacgttacgtacgtaaactaaaccgtccgtaaaccgtacgtaccgtacggacggaacccgacgggtaaccgaacccggacggttaaccgtaaggtttacccggttaaacgtttacggttagggtacccggaggttaaacgagggtaaaccaaccgacccggtaacccgtaaacggg

SEQ ID NO: 265263 - DNA, 702 bp, Homo sapiens
  misc_feature: GYAE6OF01DSFCR.34.26.C04.1.454.CMB.1.raw
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttggctgagtctgggttttcctgttgcttcttttaagnggtgtccagtgtcaggtncagcgtggtggagtcgtgggggacgcgtcggcccaggcccgtgggcctccctgacgtcctctcgtggtcncgagtccgttctaaggctttaccaccctttnaaggtagtctaagtggactattgcctacggtcggggtcccaccgnggtaccctccggagggaccgtaaggggtcgtggggacggttggggcggactaaggtttataggtgtaactggaagttagggaaaccgtgtactaaagtacttagtcggtacaacggttcccgtacgggtaagggaaccgggtacccgtacgtttaacccgaccccggttctacccgaaaggaaccgaaccgtaacctaaccccgaaagtaacccgacgtacgtacgttactacgtaacgtaactaaaacgtaccgacctacgaccggtaggaccggtaacggaccggacggacgtaccggtaactagttacgttacgtgtacggtaggacggtaaggaacgtagaacggtccgccgtaacgg

SEQ ID NO: 265264 - DNA, 737 bp, Homo sapiens
  misc_feature: GYAE6OF01B0TZ1.34.26.C04.1.454.CMB.1.raw
  modified_base (184)..(184): a, c, t, g, unknown or other
  misc_feature (184)..(184): n is a, c, g, or t
tcagtacacgtgatcacgaccggtgctcgatttagtctagcgactttgggtttggggctgggagaggagcccagcactagaggtcggcggttgtttccattcggtgatcagcactgaacacagaggactcaccagtggagtttgggctgagtcgttgggtttttcctcgttgcttcttttaagnggtgtccagtgtcaggtgcagcgtggtggagtcgtggggagcgtggcccaggccgtgggacctccctggacgtaccttctccgtggtcgcgaggtcgttcgtggtactttccacctttacagtacgtcagtcggctagtcggcctaccggttcggggtccctaccgaggccctaccggaaggacggtaaggggtcgtgggtacgggttcggggaggtactaggttagtagttcgggttaagtacggtaagtagggtaaacggttacgtaactaaagttaaccgtagtacggacaacggttaccgttacgggtacgggaacggggtcccgtaacttacccgtacccgttacctaaccgaaggtaaccaaccgtaaaccgtaacccgaaagaacccgtaccgtgttacgtaacttcgtaacgaactaaagtcccgaacacggtacgtaggaccggtacggaccggtaaacgacgtaaccggtacttaggttacggttaacttcgggagtacggacggtaaacggttagaacccggtacgaccgtcccgtaacggg

SEQ ID NO: 265265 - DNA, 825 bp, Homo sapiens
  misc_feature: GYAE6OF01D43VY.34.26.C04.1.454.CMB.1.raw
  modified_base (189)..(189): a, c, t, g, unknown or other
  misc_feature (189)..(189): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggacctcaccagtggagtttgggctggagtcgttgggttttcctcgttgcttacgtttttaaaggnggttcgtccgaggtgtcgaggtcgcgaggcgttgggtgggtacggttcgggtggggggacgtccggtcggcccctaggcccgtagggtacccgttcccgtagaacgtccttctccgtggtcgacgcggtccgttcgtacggtactttcccgacccgtttgaaggttacgtacagttcggacctagtccggaccgtaccggttccggggtacccnccgtacgggtccctaccgggaagggacggtaacgggggtctaggggtaggttcggggacggttacttaaggtttagtaggttacggtaaagtggaaggttacgggtaaattacgtaactaaagttaacgtagtacggaacgtaacggtaccgttaccgggtaaggaacccgggtccttagttaccccgtacccgttacacccgggtaaagaaccgtaacctaaaccggtacccaaaaggtaccctcgttacgtacgttaacgtaccgaacgtaaccgtaaagtcccgaaaccgttccggacgtacggaaacggacccggaacggtaacgggtaccaacgggtttaccttaaagtttcggttaaccgtaccggtggtaacggaaacgggagtaacggaaccctaacggcccgtgtaacccggg

SEQ ID NO: 265266 - DNA, 685 bp, Homo sapiens
  misc_feature: GYAE6OF01BWGA6.34.26.C04.1.454.CMB.1.raw
  modified_base (244)..(244): a, c, t, g, unknown or other
  misc_feature (244)..(244): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggacgtcccngagctctcctgtgcagcgtctggtacttcaccttcaagtagtcagtggctagtcgcacgtcgggtcccgccagggcctccgagggcgaaggggctgggaggtgggtggactaggtttagtagtagggtattacggagtagggtaaacgttaggtactaaaagtacgttaagtcggacctaacggtaaccgttaccgggtagggaaacggggtccgtaacgttccgtaacccgttctaacccgaaggaaccgtaactaaccgtaaccccgaaagtaaaccgtaaccgcttaacggtactactacggaacctaaagtacgaaccgtacgaaccgtacgaacggaacggccgggaaacggtaccgtaaccggtacttaaggttacgttaacgttaaccgttaggtacggacggtaaggaacggtacgacgaaccgccctaccgg

SEQ ID NO: 265267 - DNA, 812 bp, Homo sapiens
  misc_feature: GYAE6OF01DMN3X.34.26.C04.1.454.CMB.1.raw
  modified_base (183)..(183): a, c, t, g, unknown or other
  misc_feature (183)..(183): n is a, c, g, or t
  modified_base (220)..(220): a, c, t, g, unknown or other
  misc_feature (220)..(220): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (459)..(459): a, c, t, g, unknown or other
  misc_feature (459)..(459): n is a, c, g, or t
tcagtacacgtgatcacgaccggtgctcgatttagtctagcgactttgggtttgggctgggagaggagcccagcactagaggtcggcggtgtttccattcggtgatcagcactgaacacagagactcacagtggagttggctgagtcgttgggttttcctgttcgtacttacgttttaaaggnggttcgtccgtagtgtcgaggtgcgaggtcgttgggnggtacggtcgggtggggggacgccggtcggcccgtacgggccgttcggggtaccgtccctaggacgtccttccgtccgtggtcgacgaggtccgttcgtcggttaacctttccgtaacccgtttgacgttacgtcgacgtcggaacncgttcggaccgtcggtccggggtaccnccgtacgggcctaccgggaggacgggaacgggtcggtggggtaggtggggtagtacgttaggttntaggttaggtacgtaggtagtaaggtaagtctaacgaaagttcgtaacgtgaacccgtacgttaacccggttccggtaagggtaaccggtaccgtacgttacccgtaccggttacccgaacgaacggtaacaaacccgtaaccgtaacccgtaaaccgaaccgtacgtaccgttagtaccgtaacgtcgaaaacgttaccggtaccggtaaccgacggttaaccggacgtaacggaaccgggtaccggtaacgggaaccctaaggggttaccttaaagttcgtttaaacggttcgtacgggtaacgttcggaaaggtaacggaccgaccgttaaacccggccgttaaccgggg

SEQ ID NO: 265268 - DNA, 816 bp, Homo sapiens
  misc_feature: GYAE6OF01CBVZA.34.26.C04.1.454.CMB.1.raw
  modified_base (200)..(200): a, c, t, g, unknown or other
  misc_feature (200)..(200): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcttgggttttcctcgttgcttacttttaagaggtgtccagtgtcaggtncagcgtggtggagtcggtgggggagcgtcggcccaggtccgtgggaccgtcccgtagacgtacctccttccgtgtcgacgaggtccgtcgtggtacttccacctttcgagttacgtcaagttcggactacgtcgaccgtacggttccggggtccccgaccgtacggtccctacccggagggaccggaagggggtcgtagggtagggtggggtcggtacttaaggtttacgtaggttagggttagtaaggtagtagggtaaatacgtaactaaacttacgtagtacggaccgtaacggtaacccggttaccgggtaaggggtaacccgggtacctttaaccgttccccgtaaccgttcctaacccggaaaggtaaccgtaaacccaacccgttaaacccgaaaacggtaccctaacgttacgttaacgttactaccgtaactaaacgaaaccgtccgaaccgtacgtaccgaagggaccgtaaccgggacccgtaaacggaacccggtaccggttattaacggttttaccggttaagtttcccgggagggtaaccggaaccgggtaacggaaacggtacccggtaacccgtaaccgggtacccctttaaaccggggg

SEQ ID NO: 265269 - DNA, 708 bp, Homo sapiens
  misc_feature: GYAE6OF01DJFPH.34.26.C04.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttccncgttgcttcttttaagnggtntccagtgtcaggtgcagcgtgggtggagtcggtgggggagtcgtggcccagccgtgggacctcctgacgcctcgtctgtgcagcgtgtgtacttcaccttgaagtctcgagtcggctagtcgacgtacggttcgggccccaccgaaggtcctacccgaggggtaccgtaacgggggtcttacggggaaggttccggggtaggacttaagggttttaagtagtaggggttaacgtggtaacggtaagggtaacgttacgttaacaaagtttaacgtgtacgacgtaacgtaaccgtccggttaaggaccggtacctagttcccgaccggttcacgaagtacgtaactaccgacctaaagacgtaccgtctaataccgtcgtaacgactaaacgtccgaacacgaccgtagaccggacggtaacccggaggttaccgaacggttaccgtttaaagtccggtttaacttaacggcgggttacggaaagaccggaaaacggtcccgaaacgttcggaacccccggtaagg

SEQ ID NO: 265270 - DNA, 867 bp, Homo sapiens
  misc_feature: GYAE6OF01EFV1I.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccagtggtaggttggctgacgtcgtttcgggttttccttcggttgtcctttacgttttaaggacggttcgtccgtaggttggttaggtcgcgtagtcggttgggtggtacggttcgggtaggggggcggccggtaccggccccgaggtcccggttacggggtacccgttcccgtacggacggtaccttcccgttcgtggtcgccgtacgtccggttcgtacggtactttaccgtaccgttacgtaacggttacgtaccgtagtcggtactacggtccgcccggtcgggttcccgggtaccccgaacccggtccgggtaccccgtaccgggtaccgggaacggggtaaccggggttcgggttagggggttaacggggttcggggttacggtacgtttaaggtttaacgtaggttaaggttaggttaacggtaagggttaaacgggtaagttacggttaaacgttaaacgttacgtaacgtaccggataccgtaccgtaacgtacggtacggtacggtacctacgttccgtacctaccgtacgaacgtaccgaactaacctaacgaaccgtacgtcctaacgttcgtaccgtagtaacaacgtaacgtacgaccgtacgtaccgtaacggacgtaacggaccgggtaacgtaccggacgtttaacggttacgttaaacggtttaccttacggacgtaccggaggttaacgaaggttacgaacggttccgacgttaccggg

SEQ ID NO: 265271 - DNA, 784 bp, Homo sapiens
  misc_feature: GYAE6OF01DS3A9.34.26.C04.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (454)..(454): a, c, t, g, unknown or other
  misc_feature (454)..(454): n is a, c, g, or t
tcagtacacgtgatcacgaccggtgctcgatttagtctagcgactttgggtttgggctgggagaggagcccagcactagaggtcggcgtgtttccattcggtgactcagcacttgaacacagaggactcaccagtggagtttggctgagtcttgggttttcctgttgcttacgtttaagnggtntccagtgtcaggtgacagcgtggtacgagtcgtggggacgcggtcgacccgagccgtggaccgtccgtagaacgtccttcgtccgttggtcgacgtacggtcgttacttacggtaacttcccgtaacccgtttgaagttacgtcaagttcggactatcgctacggtcggtcccacgtaggccctacgagggtccgaaggggtctgggacggtgggtacggactagtttgtaagttggtagtgaagtaggtaaagtacgtaacaaagtttnaacgtggaccaacgggttacccgttacgggtagtaaaccgggtcctaacttacccggacccctttacgaaccgtaaggtaaccaaccgtaaacctacccgaaacgtaaaccgcccgttaacgttacgttaacgtttacccgaaggtaaacctaaaccggttacccgaaaccccggttagtacccgggtaaacggaaccgggtacccggaaccggtaaacggccccgttaaaacggtccttaaacgttaccgggttttaaacttacggttccggacggtaaaccgtaaacggtaaccgtaacgtacccgtaaccggttaccctaaccgggg

SEQ ID NO: 265272 - DNA, 640 bp, Homo sapiens
  misc_feature: GYAE6OF01BEFGC.34.26.C04.1.454.CMB.1.raw
  modified_base (180)..(180): a, c, t, g, unknown or other
  misc_feature (180)..(180): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttacttttaagnggtgtccagtgtcaggtgcagctggtggagtcgtgggggagcgtggcccagccgtgggaccgtccctgacgacctctccgtgtcgcgagtcgtcgtggtacttccaccttcaggttagtcagtggctagtcgacctaccggtcgggtccccgaccgtagggtccctaccgagggtacgaaggggtctagggngtggggngtactagttatagtggtatggagtaggtaagtagtactaaatactagtgacacgtacgtcggtaggacggtccgtacttaccgacctacgaccgaagaacaaccgaactacccgaaagaccacgtcgtactactacgtacgactaagtccaaccgtacgacgtacggacggacggtacggaacggaccgtacgtacgttaggttacgtacgttacggtcgtacggacgtaaggacgtaaccgaccgtacgaccgtaaccgg

SEQ ID NO: 265273 - DNA, 684 bp, Homo sapiens
  misc_feature: GYAE6OF01B3URR.34.26.C04.1.454.CMB.1.raw
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccctgttgcttcgttttaagaggtgtccagtgtcaggtgcaggctgggtggaggtcgtggggggagcgtgggcccaggcccgtggggacctcccctggacgtaccttctccgtggtcgacacggtccgttctggtaactttccgaccctttgaaggttacgtctagtcggctagtcgcgtacggtcgggtcccnccgaggcctaccgaggccgaggggtctagggtaggtgggtgctaaggttatagtggtataggagtaggtaagtacgtacaaagttactgtcgacgtacgtaccgtccggttaggaaccgggtacctacgttacccgtacccgttccgtaaccgagaaccgtaaccgtaaaccgtaccccgaaagtacccgacgtacttgtaacctacgtgaactaacgtaccggaaccacgttaccgagggaaccgacggtaacccggaggtaccgaccggtacttacgtagttacttcggtagtacggacggtaaagcgtaacgacctagcccgtaacgg

SEQ ID NO: 265274 - DNA, 801 bp, Homo sapiens
  misc_feature: GYAE6OF01BM0OZ.34.26.C04.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttgggctgagtcgttgggttttcctcgttgtcttcgttttaagnggtgtccagtgtcaggtncagcgtggtggaggtcggtgggggacgtcggtcggccccgaggtcccgttggggacccgttcccgtaggaaccgtccgttcgtccgtggtcgacgacggtccgtcgttaggtaacttccgtaccctttagtaggttacgtctaggtcggacctagtcggccgtacggttccgggcccgcgacggtccgtacggaggaccggtaaggggtctagggtagggtgggtcggacttaggtttacgtagtaggtactaggtaagtacgggtaagtacgtactaaagttacgtacgcgtaacgtacggtacccggtacggtaacggaacgggttaccccttacgtacccgtccccgttaacgaccgtaaacgtaacgaaacccttaaccgaacccgaaacggtaacctacggtaccttaggtttaacacccggtaagtaacccgtaaagtacccgggaaacctaccgggtcgttaaacgggaaccggtaccgaccgggaaggttacccgaaacggttcgttaaaccgtttggttaaaccgttcggtagggtaacaccgggttaaaggaccgttaaacgggaccctaaccgggtaacccgtaacggg

SEQ ID NO: 265275 - DNA, 768 bp, Homo sapiens
  misc_feature: GYAE6OF01EYZI2.34.26.C04.1.454.CMB.1.raw
  modified_base (182)..(182): a, c, t, g, unknown or other
  misc_feature (182)..(182): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgcttcttttaagaggtntccagtgtcaggtgcagcgtggtggagtcgtgggggagtcggtcggccccagccgtcggggaccgttccccgtagacgacctcctccgttggtgccgagcgttcgtggtacttccaccttcagtacgtcagtcggcagtcgccgtacgtgggtcccgccgaggtcctaccgagggacggtaacggggtcgttggggaggtaggggtcggctaaggtttaacgtagttaggggttataggagttaagggtaaacgtttagtaacctaaaagttaccgttaatcggacgtaacgtaccggtaccggtaacgggaacggtaccccgtaagtttaccccgaacccggttaccgtacccggtaagaaccgtaaccgtaaacccaaccccgaaacgaaccgtaccgggtactttaacgggtactttaccgaaagtaacccgtaaagtccgaaacccgttcggaacgtaacggaaggacccggtaaccgggaacggtacccggaaaccggttaagttaacgtttagttaaacgtttcggtacgtcgggaaaccggaggtaacggaaacgacccgaacggtaacccctaacggg

SEQ ID NO: 265276 - DNA, 802 bp, Homo sapiens
  misc_feature: GYAE6OF01ETUIT.34.26.C04.1.454.CMB.1.raw
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctgagcttgggttttcctcgttgcttcttttaagagtgtccagtgtcaggtgcagctggtgagtcgngggggagcgtgccagccgtgggacctccgtgacgtcctcctccgtgtcgacagtcgtctggacttccgtacttcgtaagtcgttacaagtcggactacngtccgaacgtcgggtccgcccgaggtcctaccggaggaccgaaggggtcgtcgggtaggtcggggtacgtctaaggtttaagtagttggtaagtcggtaagtaggtaaacgttagtacgtaaaattaccgagttaccggactaacggtaccgttaccgggtaacggaaacgggttacccgtacgtttaccccgtaaccggttccgtaaacccggtaaggtaacccggtaaccgtaaaacccgtttaccccgggaaaaaccgtaaacgtaacccggtacgttaccggttaacgtcccgtaaacgtaaaccgtaaaacggttaccgtaaacccgtaaccggtacccgttaaggaaccggaaaccgggaacccgggaaacgtaaccccgggtaaacgttacggttaaccgttaaggttttaaaccgttaccggttagggtaccgaaacggtaaacgaacggtaaccgtaacggaacccggtactaacccgggg

SEQ ID NO: 265277 - DNA, 625 bp, Homo sapiens
  misc_feature: GYAE6OF01CG7AM.34.26.C04.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgcttcttttaagnggtgtccagtgtcaggtgcagctggtggagtcgtgggggagcgtggcccaggcctggggacctccctgacgactctccgtgtgcagcgtctggattcaccttnagtagtcagtggcatgcacgtgggtcccnccgaggcctccgaggcgaaggggctagggagtggggtgctaggtttatagtgggtatggagtagggaaagttgtacaaatactagtgacagaccgtccggtaggaacgggccgtaattccgaacccgttctaccgaagtacgaacctaactacccgaaacgaaccgacgtctagtaactcgtagaactaaatccgaaccacgtccgtaggacgtacggacccggaaggaccgtaccgggtacttaagttacggttaacgtttcgtacgggtaggaccggtaacggaacggaacgaaccgtaccggccgtaaccgg

SEQ ID NO: 265278 - DNA, 654 bp, Homo sapiens
  misc_feature: GYAE6OF01CBZ7K.34.26.C04.1.454.CMB.1.raw
  modified_base (296)..(296): a, c, t, g, unknown or other
  misc_feature (296)..(296): n is a, c, g, or t
  modified_base (619)..(619): a, c, t, g, unknown or other
  misc_feature (619)..(619): n is a, c, g, or t
tcagtacacgtgatcacgaccggtgctcgatttagtctagcgactttgggtttggggctgggagaggagcccagcgctagaggtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcggtggcccaggccgtgggaccgtccctagacgaccttcctcctggtgctaggccgtctgggtacttccacctttnagttagtccagtggctagtgctacgtcggggtcccgccgtaggcctaccggagggaccgtaagggggcgtgggaggtggggtaggtctaaggtttagtagtgggttaatggagtagggtaaagtgtacaattatagtgacgtagtaccgtccggtaaggtacgggtccgtacttccgacccgtactccgaagacgaaccaacgtacccgaaagaaccgacgtacctaggtaacttcgacgacaaacgtcggaacctagtaccgtagaaccgggacgaccgggtaacggaccgtacgggtacgttagttacgtacgtttacggngtacggacggtaacgagaagaccgcgccgtaacgg

SEQ ID NO: 265279 - DNA, 630 bp, Homo sapiens
  misc_feature: GYAE6OF01BEHGK.34.26.C04.1.454.CMB.1.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (558)..(558): a, c, t, g, unknown or other
  misc_feature (558)..(558): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttcttttaagaggtgtccagtgtcaggtgcagctggtggagtcgtgggggagcgtggcccagccgtgggaccgtccngacgctctcctgtgcagcgttcnggacttccacttgaagtagtcagtggcatgccacgtcggtccgcaggcctaccgagggcgaaggggtctgggacgtgggtcggactaagtttacagtggtaactggaattagggaaattgtaacaattacgtatcggacaacggtactcggtaggaacgggtacctagtacctaccgtcctaccgaagaccgaactaacgtacccgaaacgaaccgccgtacttagtaaccgtcgtacgaacctaaacgtcggaacctacgccgtaagacggacccgtacggaacggtaccnccggtaagttgttacgttaacgtcgttgggtaaccgacggaacgagtaccggaactacccggtactaaccgg

SEQ ID NO: 265280 - DNA, 627 bp, Homo sapiens
  misc_feature: GYAE6OF01DSJ3J.34.26.C04.1.454.CMB.1.raw
  modified_base (159)..(159): a, c, t, g, unknown or other
  misc_feature (159)..(159): n is a, c, g, or t
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcngtgctcttaagagtgtcagtgtcagtgcagctggtggagtcgtaggggngcgtcggccagccgtgggacgtccctgacgtactctccgtggtncgaggcgtacgttggacttccgaccttcgagtacgtcagtggcagtcgcgtacgtcgggtccncgagcctaccgaggaccggagggctagggtacggtgggtgacgtagtttaggtagtggtaatggtacttaaggggaactttacggtaataaacgttctaaacgtccgaagtacgtaccgtacggcggaaacggtccggtacttccgacccgttacgtaccgaaggaccgtaactaaccgtaacccgaagtacgacgttctaggaactcgtagaactaacgcgacgtacgaccgtagacggtacgacgacgtacgacgtaccgttagtatacgttgtcgtagacgaggtacgaagtacccgtaggcctaacgg

SEQ ID NO: 265281 - DNA, 752 bp, Homo sapiens
  misc_feature: GYAE6OF01CND08.34.26.C04.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
tcagtacacgtgatcacgaccggtgctcgatttagtctagcgactttgggtttggggctgggagaggagcccagcactagaggtcggcgtgtttccattcggtgatcagcactgaacacagagactcacagtggagttgggctgagtcttggttttccngttgccttagttttaaagnggtcgtaccagttgtacgaggtgacaggcgtgggtaggagttcggngggggacgcgtcggaccctaggccgtgggacctccgagacgtcctccgtcgtggacncgaggtcgttcgtaggtacttccaaccgttagaagttacgtcagtcgactgtcgacgtacgtcgggtaccncgcgaccgtccggaaggacggaaagggtctaagggtggtagggtagtagttaagttagtagttaggtagtacgtaagggtaggtaaaagttacgtaaactaaacgttacgtaagttacgaccgtaaacggtaccgttaaccgggtaaggtaaaccggttcccggtaacttaaccccgggtaacccgttaccgaacggtaaacgtaacggtaaaccctaaaccgtaaacccggaaacgaacccttacggttacacggtttaactacggtaaacgaaacctaacgtacgaacccgtagtaccggtaggaaccgcgtaaaacccgggtagaaccggtacgtaacttagtaacgttacgtaaccgtagaccgaacggacgtaacgaacgaccacgtacgtaacg

SEQ ID NO: 265282 - DNA, 776 bp, Homo sapiens
  misc_feature: GYAE6OF01BMLPU.34.26.C04.1.454.CMB.1.raw
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgtttgcttcttttaaagnggtgtccagtgtcaggtncagctggtgagtcgtggggngcgtcggccagtccgtgggacctcctgacgtcctctccgtgtcgcagtcgtcgtggtactttccgaccttnagttacgctagtggctagtcgccgacgttcgggtcccaccgaggtcctaaccggagggtacgaaagggggtccttagggggtaacggttggggtacgtcgttaaaggtttacgtggttagggttaacgtaggaaacgggtttagggtaaaaccgtttcgtaacgtaaaagtttaaccgttaggtaccgaaccgtaaagttccccgggtaccggtaaggggtaaccggtacccgttaaccgtttccggtaacccgttacccgtaaccggaagtaaaccgtaacccgtaaaccgtaacccgtaaaacgaaccgttaccgtacgtttagtaaccgttcgttaaacggaaccttaaaggtacccgaaccgtacggttacccgaaggtaccggaccggtaaccgggaacgttacccggtaaggtacttacggttattaacggttcggtacggtaggaacggagacgtaacgacgtaccgaccgtaacggg

SEQ ID NO: 265283 - DNA, 892 bp, Homo sapiens
  misc_feature: GYAE6OF01EEAAK.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttgggctgggagaggagcccagcactagaggtcggcggtgtttccattcggtgatcagcactgaacacagagactcaccatggagtttgggctgagcgttgggttttcctcgttgtcttcttttaaaggnggttgtccagttgtcgagggtgcagtcgttgggtggtagtcggtaggggggagcgtcgggaccccaggcccgtacggggtacccgttccctggtaaccgtacccttcgtcccgttggttcgaccgtaggtccgtacgttggtaactttcccaacccgtttcgaacggttaagtctagttcggctaagttcgaccggtaccggttccggggtacccgaccgacgggtcctaccggagggtaaccggtaacgggggtcgtaggggttaacgggttcggggttacgggaccgtttaaggtttaagttagggttaaggttacgttacggaaaggtttaacggggttaaacgttaaggttaactaaaccgttttaagtaaacgttcggaaacccgtaaacggttaccggttaaccgggttaacgggaaaccggggtttaccctaaccggttttacccggtaaacccgttaccgttaaccggaaagtaaaccccggtaaaccttaaaccggtaaaacccccgaaaggaaaccccgtacggttcgtttaactaccggttcccgaaagttaccgaaaaccgttccggaaacccgtacggtacccgtacgggaacggtaccgacccgggtaaacgaccggtacgggttacttaacgtttaaggttaacttcgggttaggaccggttaaggaaacggacgtaacgactacgccggtaaacg

SEQ ID NO: 265284 - DNA, 755 bp, Homo sapiens
  misc_feature: GYAE6OF01DB20E.34.26.C04.1.454.CMB.1.raw
  modified_base (179)..(179): a, c, t, g, unknown or other
  misc_feature (179)..(179): n is a, c, g, or t
  modified_base (561)..(561): a, c, t, g, unknown or other
  misc_feature (561)..(561): n is a, c, g, or t
  modified_base (602)..(602): a, c, t, g, unknown or other
  misc_feature (602)..(602): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaaagnggtgtccagtgtcaggtgcagcgtggtggagtcgtgggggagcgtcggcccaggccgtcgggaccgttccctgacgacttctccgtgtcgcagccgtctggattccacccttcgagtagtcagtcggacagtgacctaccggttcggggtccccgcgacgggtccctacccggagggtaccgaaaggggggtccttagggggacgttgggggtcgacgttaaggttttaagtaggttaggttaagtggtaagtaggggtaaagttagtactaaagttaactagtagaccgtaacggtccgtaccggtagggaaccgggtccgtacgttacccgacccgttccgaaccgtaaacggacgaacctaaaccgtaaccccgaaaanacccgtaaccgtcgtaacgttacgtctaacgaccgttaaanccgtaacccgtacggccgttaacgggacgaccggtaacccgggaacgggaacccgtacggtaccgttacggttaagtttaacggtttacgtacgggtacggtaacccgggtaaggaacggaaccgaaccggtaacccgccggttaaacccggg

SEQ ID NO: 265285 - DNA, 671 bp, Homo sapiens
  misc_feature: GYAE6OF01DCGZA.34.26.C04.1.454.CMB.1.raw
  modified_base (228)..(228): a, c, t, g, unknown or other
  misc_feature (228)..(228): n is a, c, g, or t
  modified_base (332)..(332): a, c, t, g, unknown or other
  misc_feature (332)..(332): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
tcagtacacgtgatcacgaccggtgctcgatttagtctagcgactttgggtttgggctgggagaggagcccagcactagaggtcggcggtgtttccattcggtgatcagcactgaacacgagaggactcaccagtggagtttgggctgagtcgttggttttcctcgtttgacttcgttttaagaggtgtccagtgtcgaggtgctagcgtggtggaggtcgtaggggngcgtggcccagccggtagggaccgtcccgtgacgccttcgtccgtgtcgctacggtccgttcgtaggtacttccgtaaccttacgaggttagtcctagtcgganacgttggccacggttcgggtccaccgtacgctacccgaggngaacgggcgtgggacgtgggtcgctagttagtacgngtagngtaagtaggtaagtacgtacgtaaacgtagtacgtgaaccgnggtaacccaccggtaggtaccggtaccgtacgttaccgtacccggttaccgaccgtaacgacgtaaccgtaaccgtaaccgaaacgtaaccgccgacgttagtacgaccgttagaacacgacgtaacgtacgctacggagacgtacggacgaccgacgttacgtacgttagttactgtccggtagacggtaacgacgaaggactcgaccgtacgg

SEQ ID NO: 265286 - DNA, 642 bp, Homo sapiens
  misc_feature: GYAE6OF01D8248.34.26.C04.1.454.CMB.1.raw
  modified_base (259)..(259): a, c, t, g, unknown or other
  misc_feature (259)..(259): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagcctgggacctccctgacgcctctccgtgngcagcgtctggacttccaccttcagttagtcagtggcatgcacgtcggggtcccgccgaggccctaccgagggcgaaggggctgggagtggggtcgctagttatagtggtatgagtaggaagttagtactaaatactagtcgacgtaacgtaccgtacccggtagggaaccggggtccgtaactttcccgtacccgtacctaccgaagaaccgaaccaaccgtaacccaaagaaccaccgtacttacgtacttcgtacgaactaaacgtaccgaacccgacgtaccgtaaggacgaacggtacccggaaggaccggaaccggtacgtaacgttagttaacgttacgtaggtacggtacgaaggaagagaccacggcctaacgg

SEQ ID NO: 265287 - DNA, 793 bp, Homo sapiens
  misc_feature: GYAE6OF01A68K6.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggcccaggccgtgggaccgtcccgtgacgtaccttcctccgtgtgcaggtccgtcgtggtaactttccaccttcagttacgtcagtggactagtcgaccgtacggtcggggtccccgacccgtagggcccttacccggaaggggaccgaaacggggggcttagggggaggttcgggggtcggaccgttaaggttttaacgtaggttagggttaagttgggtaaaggttagggtaaaacgttacggttaacctaaaagtttacccgttaagttcggaaccgtaaacggtaaccccggttacccgggtaacggggaaaacccggggttaccccgttaacgttttacccgtaacccccgttaccggttacccgaaaggtaaccggtaaaccctaaacccgtaaccccgaaaagtaaccgaccggtacttacgtaacgttacgtacggaactaaacgtaccgtaaccgtacgtaccctagggacgaccggaccggaacgggaccaaccggtacgtacgtacgttaattcggtcggtagaccggtaagaaggaccgaaccgcgtaccgtaacgg

SEQ ID NO: 265288 - DNA, 790 bp, Homo sapiens
  misc_feature: GYAE6OF01AEDWD.34.26.C04.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
  modified_base (611)..(611): a, c, t, g, unknown or other
  misc_feature (611)..(611): n is a, c, g, or t
  modified_base (758)..(758): a, c, t, g, unknown or other
  misc_feature (758)..(758): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttggctgagcttgggttttcctcgttgcttctttttaagaggttntccagtcgtcaggtncagtctggtggagtcgtaggggggcgcgtcggaccctagcccgtggggaccttccctggactacctccgtccgtggtcgacaggtcgtaccgtggtactttccaccgtttnaggttagtaccagttaggcctaattcggacctaccggttacgggtccccgacccgaaggggtccctacccggagggaccggtaacgggggtcctttaggggggacgttgggggttcgaaccgttaaggtttaagtaggttgggtaacgtggtaaggtacggtaaagttacgtaacgtaaactaacgttagacgggactaacggtacccgtttggaacgggtaaacggggtccctaagtttccccgacgttacccgtaaccgaacgtaaccgaaccgaaaccctaccccggaaaggtaacccnccggttacgtagtacccgtttagaccgaaacccttaaacgggcctaacccgacggttaccggaacggaccggtaaccggaacccgggaggaccccggtagtaacccttaggtacccgttttaaaggtcccttagggacgtaacccgnggtaaacccacggtaacgaccgccggtaaccg

SEQ ID NO: 265289 - DNA, 921 bp, Homo sapiens
  misc_feature: GYAE6OF01EV856.34.26.C04.1.454.CMB.1.raw
  modified_base (208)..(208): a, c, t, g, unknown or other
  misc_feature (208)..(208): n is a, c, g, or t
tcagtacacgtgatcacgaccggtgctcgatttagtctagcgactttgggtttgggctgggagaggagcccagcactagaggtcggcggttgtttccatttcggtgatcagcacttgaacacagacggactcacagtggagtttgggcttgagtcgttgggttttcctgttgtcttacgttttaagaggtcgtccagttgtcaggtcncgtagtcgttaggtggtagtcggtggggggagtccgttcgggcccctaggcccgttagggaccttccctggaaccgtaccttccgttccgtgggtactaccgtacggtcccgttacggtacgggttacctttacccgtacccgttttcgaacggtttaacgtccgtaaggttccgggtcctaacggttcggaccgttaccgggtttacccggggtccccgaccgtacggggtccctttaccccgggaaggggtaccggaaacgggggttcccggttaaggggtccgggttcggggtaccgttaacgtttaaggtttaacggttacgttacggggttaactacggtacggtttaggtaaacggttcgtttaacccgtaaaagtttcccggtaaggtccgtaaccgtaacgttacccgttacgggttacgggtaccggtacccttacgtttacccggtacccggtactaaaccggtacgggttaaacccacgttaaccccggtaacccgaaaccggtacccgtacggttacgtttacgttacgaccgtgtaaacccggttagaccggttacgaccggtttacggacgtaaccgggtaggccccgggtaaacgtaccggtaccgttacgtaacggttttacggtaaaccggtttcggacgggtaacgtacggtaaaccgggtacgaaccggttacctaggggtacccccttagggg

SEQ ID NO: 265290 - DNA, 676 bp, Homo sapiens
  misc_feature: GYAE6OF01C3KXK.34.26.C04.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaaagnggtntccagtgtcaggtgcagctggtggagtcgtgggggagcgtgcccagcctgggacctcctgagactctccngtcgcagcgtctggacttcaccttcagtagtcagtcggcatcgacgtacgtcggggtcccnccgaggcctaccgaagggccgaaagggggtctagggaggtggggtacggactagtttactagttggtataggagtagggtaaagtagtacaaagttactagtaggactaacggtaccgttaccggtacgggaacgggtacccgtaacgttcccgtaacccgttccgtaacccgaaggtaccgtaaccgtaaacgtaacccccgaaaagaaaccgaaccgtccgttaacggtactaccgttagaaccgtaaacgtccgaaccgtaacgtccgtaggtacgacgtaccggaacggaccgacgggtactaacggttattaacgttcggtgtacgacggaacgagaaccgacgaccgtcgtaaccgg

SEQ ID NO: 265291 - DNA, 904 bp, Homo sapiens
  misc_feature: GYAE6OF01DC5F1.34.26.C04.1.454.CMB.1.raw
  modified_base (199)..(199): a, c, t, g, unknown or other
  misc_feature (199)..(199): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggacctcaccatggagtttgggctgagcttgggttttcctcgttgcttcgttttaagaggtgtccagtcgtcaggtncaggcgtgggtaggaggtcgtggggggaggcgtcgggaccccaggccgtggggaccgtccctaggacgaccttctccgtggtcgcgagccgttcgtaggtaccttaccgtaccctttacgtaggttaacgtccgaagtcggtaccagttccgaccgtaaccggttcggggtccccgacccgacggtacccctaccggaagggccgtaaaggggtccgttcggggaggggttgggtaccggtactaaggtttaataggtacgggtaagtacggagtaacgggtaaagtagttaaccgtaacttaaacgtaggtcgtaaccgtaaacgggtccctttaccgggaacggtaacccgggttcccgttaaacgttccccgtaaaccccggttcccgtaaaccggaaggtaaccccgtaaacgttaaaacccgtaaacccccgggaaaagtaaacccgtaacccggttcgtttaaaccggttactacccggttaaagtaaaaccccgtaaaggtccccgtaaacccggtaccggttacccgaagggttacccgggaaaacccggacccggaaaaacccggttcccgggaacccgggtttaccttaaacggtttaaccggtttaacggttcgggtttaacccgggaacggaaccgggggtaaaacaaacgggggttaaccgaacccggtaacccgtccccggttaaaacggg

SEQ ID NO: 265292 - DNA, 856 bp, Homo sapiens
  misc_feature: GYAE6OF01DHBBF.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcacagtggaggttggctgagtcgtttcgggttttcctcgttgtccttattttaaggaggttgtccgtggtgtacgaggtgcgaggtcgtgggtggtacggtcgggtggggggacggtccggtccggacccgtacggccggtcgggtaccgttcccgtagacgtccttccgtcctggtnaccgtcggtccgtcgtacggtacttacctaaccgtgtacgttaggtacgtagtcggactcgtcggaccgttccggtccgggtcccgtccgaaccgggtccgaaccgggtacgggaaccgggtacggggttcggtagggggttacgggtcggggtacgtacggttaaggttttaaacggttaagttgggttaaacggtaagggttaacgggttaacggttaaaagttacgtaacctaaaagttaaccggttacgtacgaaccggtaaacgggttacccggttaacggtacggggtaaacccggttccgttaacgttaccccgtaaccgttacccggtaacgaaacggtaaaccgaacgtaaccgtaaacccgtaaacaccggtaccgttagttacgtaccgtactaacgtaaccgtaacgtacgtacccgtaacgcggtaaacggcggaacggtaacccggcggaaaccgtaccgttaggttcttaaacgttaacggtgtaccgggtaagacggtaacggcggtaagacccggtacgtaccccgggttaacg

SEQ ID NO: 265293 - DNA, 928 bp, Homo sapiens
  misc_feature: GYAE6OF01EZW4U.34.26.C04.1.454.CMB.1.raw
  modified_base (187)..(187): a, c, t, g, unknown or other
  misc_feature (187)..(187): n is a, c, g, or t
  modified_base (265)..(265): a, c, t, g, unknown or other
  misc_feature (265)..(265): n is a, c, g, or t
  modified_base (887)..(887): a, c, t, g, unknown or other
  misc_feature (887)..(887): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggtttttcctcggttgtcttcgttttaaggnggtcgtccagtgtcaggtgcagtcgtggtggaggtcggtagggggagcgtcggcccaggtccgtgggacctttcccgngacgtaccttccgtccgtggtcgcgtacggtccgtcgttacgggtaactttcccgtaacccttttacgaaggttacgtccgtaagttcgggactaacgttcggacccgtaccggttccggggttacccggaccggaaccgggtcccctacgggaacggggaccggtaaacgggggggttccttagggggtaacgggttcgggggttacgggaaccttagggtttaataagggtttacggggttaagttaggtaaaggtttagggtaaacggtttaacgtaaccgtttaaaaagttacccggtttaagtaccgggtaacgttaacccgggtaacccggtttacccggggttaacggggtaaacccgggggttacccgttaaccgttttaccccggtaaccccgggtttaacccgtaaaccggtaaaccgggtaaaacgtaaaccccgtaaacccgttaaacccgaaaaacccggtaaacccggtaccgttacgtttaaccggttacgtaacgtttacggaaaccttaaacggtacccgaaccgttaccggtacgtaacgggaacggtaccgggaccgggaaacgtacccggtaacggttaccgttatttaacggtagttacgnggttacgaacggtacgtaacggacacggacgcccgtaacgg

SEQ ID NO: 265294 - DNA, 661 bp, Homo sapiens
  misc_feature: GYAE6OF01A21XN.34.26.C04.1.454.CMB.1.raw
  modified_base (177)..(177): a, c, t, g, unknown or other
  misc_feature (177)..(177): n is a, c, g, or t
  modified_base (328)..(328): a, c, t, g, unknown or other
  misc_feature (328)..(328): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttggctgagcttgggttttcctcgttgcttcttttaagnggtgtccagtgtcaggtgcagctggtggagtcgtgggggagcgtcggcccagccgtgggaccgtccctgacgccttcgtcctggtgcgagtcgtcgtaggactttccaccttcaaggtacgtcagtggcctagtgccacggtcgggtcccnccgaggtcctaccgaagggaccgaaggggcgtagggaggtgggtgactaggttatagtggtatgagtaggtaagtgtacaatatagtcgacgtacgtacgtcggtaggtacgggtaccctagttacccgacccgtactaacgaacgtaacgaacaacccgtaacccaaagacctacgtctagtactccgtaacgaacgtaaacgtccgaacgtcgtaccgtaacggacgaacccggtacggaaaccggaccgtaacccgttagttaaggttaacttacggttaacgtcggacggtaacggaacgtacggaaactccgaacgtccccgtacggg

SEQ ID NO: 265295 - DNA, 666 bp, Homo sapiens
  misc_feature: GYAE6OF01CYV72.34.26.C04.1.454.CMB.1.raw
  modified_base (181)..(181): a, c, t, g, unknown or other
  misc_feature (181)..(181): n is a, c, g, or t
  modified_base (338)..(338): a, c, t, g, unknown or other
  misc_feature (338)..(338): n is a, c, g, or t
  modified_base (548)..(548): a, c, t, g, unknown or other
  misc_feature (548)..(548): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttcttttaaagnggtgtccagtgtcaggtgcagctgggtggagtcggtgggggagcggtcggcccaggtcccgtggggacctcccgtgacgacctctccgtgtcgcaggccgttcgtggtacttccacctttcagtagtcagtcggacagtcgccgacgttcgggcccnccgacggtcctaccggaggaccggtaaggggtcgtaggggacggtggggtcgtacgtaaggtttagtagtacgggttaatggtaacggtagggtaaagttacgtactaaagttacgtagtacgaccaggtaccgtaccggtagggaacggtccttaacgttcccgacccgttctaccgaagaccgtaacctaaccgtacccgaaagaccncgtacttagtactacgagtaacaacgtcgaccgagtccgtagacgacgaccggacgacgaggtctaggttagttacttcgtaggagacgaaggaacgacgtaacgacggccctaacgg

SEQ ID NO: 265296 - DNA, 678 bp, Homo sapiens
  misc_feature: GYAE6OF01EU0VE.34.26.C04.1.454.CMB.1.raw
  modified_base (393)..(393): a, c, t, g, unknown or other
  misc_feature (393)..(393): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctggagtcgttgggttttcctcgttgcttcgtttttaagaggtgtccagttgtcgaggtgcaggcgtgggtggagtcggtgggggagcggtggcccagccgtgggacctccctgacgctctctgtgcagcgtgtggtattccgaacctttcgaagttagtcagttcggcagttgaccgtacggttcggggtcccgccgaggtccctccgagggaccgaaggggcgtagggaggtgggtgacgtagttanagttggatgagtaggaagtagtacaatacgtagtcgacgacgtaccgtccggtaggaaccggtccgtacttaccgtacccgtctaaccgagaaccgaaccgtaactaaccccgaaaagtaccaccggtacgttacgtaactcgtacgaaccgtaaagtaccggtaccaacgggttcctaggaacggtaccggaacccggaggtaacccgaggttaccgttagttacgttacgttacgtacggtcgaaacggtaggtaacggaacgtaacggccgtacgtaaccgg

SEQ ID NO: 265297 - DNA, 901 bp, Homo sapiens
  misc_feature: GYAE6OF01CHTZD.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggaggtttggctggagtcgttcgggttttccctggttcgtcttacgttttaaggaggttcgtcctagtcgtcgaggtgccgaggtcgtgggtaggacggttcgggtggggggacgtccgtcggccccagggcccgttacggggaccgtccgtaggacgtaccttcgtccgtggtcgaccgacgtccgtcgtacggtcttcctacgttgaagttacgtctagtggacaggtcgaccgtaccggtcgggtcccgacgtacggtaccctaccggaagggtaccgggaacgggtcggttaaggggtggggttaccgggtcggaacgtttaaggttaacgtaggttacggggtaaagtacgggttaaggtttaacgggaaaggttaaccgttaacgtaaacgtttaaccgtacggtctaaacccgggtacgttacccggttaccgggtaagggaaccccgggttaaccgtacgtttaacccggaccccggtttaccgtaaacggtaacggtaacgtaaaccgtaacccggttaaacgaaaccggttaacccgaacggttacgttacgttaaccgttaaccggtaaccgtaacgtaacgttaacccgaccgggtttaaaccgaccggtaacgggtaaccgggaaccggtaaccggtaacggaacccggtaggttaccgtaaaggtttaccggttaaggttacccggtgggtaacccggttaaagggaaccggaagggtaacccgggtaatacccgggtaacccgttaacggg

SEQ ID NO: 265298 - DNA, 642 bp, Homo sapiens
  misc_feature: GYAE6OF01BDPUL.34.26.C04.1.454.CMB.1.raw
  modified_base (180)..(180): a, c, t, g, unknown or other
  misc_feature (180)..(180): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (604)..(604): a, c, t, g, unknown or other
  misc_feature (604)..(604): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgttgggttttcctcgttgcttacttttaagnggttcgtccagtgtcgaggtgcagcgtgggtgaggttcgtgggggacggcgtcggcccgagccgtgggaccgtcccgtgacgtcctcctcctgtcgcgacgcgttcgtggtacttaccaccctttagagtacgttcaagtcggactagtcgactcgtcgggtcccacgtacggcctaaccggnggaaccgtaggggctagggtgtgggntacgtaagttagtgtagaactgtaacgtggaagtaacattaactaagtcgtagacgtacgtacgttaccggaggacgggtacctacgttacgcccgttaccgacgacgaagttaaccaaactccgaaagaccagttccagtactcgtaagaacgaaacgtcaaccgagtacctaggacgacggaccacggactaccggtagttacgtagtttacncggttacgaggacgtgaaaccgagctaaccgccgtacg

SEQ ID NO: 265299 - DNA, 609 bp, Homo sapiens
  misc_feature: GYAE6OF01BVL00.34.26.C04.1.454.CMB.1.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctccctgacgactctccgtgtgcngcgtctggtattcaccttcagtagtcatggcatcgcacgtcgggtccnccgaggctccgaggcgaagggggctgggacggtggggtgacgtagtttatagtggtatggatagggaagttatcgaaattactatgacgaagtacgtaccggtagacgggaccgtatccgtacccgtctaccgagaccgaacaacctacccaaacgacaccgcttagtactacgtacgacaaacgtcgtaccgtacgtaccgtaggacggaacggtaccggacggtaccaccgggtacttacgtagttaacgttcgtaggtcgacggtaaggtacgaggtaccgcggaccctaaccgg

SEQ ID NO: 265300 - DNA, 710 bp, Homo sapiens
  misc_feature: GYAE6OF01CZGH9.34.26.C04.1.454.CMB.1.raw
  modified_base (381)..(381): a, c, t, g, unknown or other
  misc_feature (381)..(381): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttggctgagtcgttgggtttttccctcgttgcttctttttaaaggaggtgtccagttgtcgaggtgcagcgtggtggaggtcggtgggggagcgtcggcccaggtccgtgggaccgttcccgtagacgtaccttcctccgtgtcgcgagtccgttgtggtaccttctaccttcaagttacgtcagtggcagtcgaccgtacggtcgggcccacgacggtcctaccggaggacggaacggggtntacggggtaggttcggggacgtacgttagtttaagtacgttaggttagacggtaagttaacgggtaagtacgttaacaagtttacgtacgtcgaacgtacgtaccggtacggtaacggaccgggtacctacgttccgaccgttcctacgaacgaacgtaaccaaccgtaaccgaaacgaacgacgttaccgtagtactacgtaacgaacctaacgtacgaaccgtacgacgtacggacgaacggtaacccggaggaacctcggtacgttacgttacttaacggttacgtggacgaacggtacggtaaacgagacccgtgaaccgtacgg

SEQ ID NO: 265301 - DNA, 791 bp, Homo sapiens
  misc_feature: GYAE6OF01BLL4C.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggttttcctcgttgtcttcgtttttaaaggaggtcgtcccaggtgtcaggtgcaggcgtgggtaggcggtcgtggggggacgcggtcggcccgaggcccgtggggtacccgtccgtaggacgtacctctcctggtcgcgaggtccgtcgtacggtacttcctaccttcgtaaggtacgtaccgagttggacctagttacgccgtaaccggttccgggacccgaccggacgtccgaccggaacgggtcgggtaacggggtcggacggggtaggttacggggtacggtaacgttggtttaaagttagttaggggtagttaaggtacgttaaggggtaaaacgttacgtaagttaaaacgtacgttaggtacgtacggtacgtaccggtacgggtacggtaaacgggtccgtacgttacccggtcctacggtaccaacggaaactacccgaaacctaacccggaaacgtaaccgtacgtacgttagtaaccgttactacgtaacctaacgtaccgtaccgaaccgtacggtaaggacgaccggtaccggaaggtaccgtaaccggttacgttaacggttacttaccggttagacgggtgtaaccggaaggtaacgacgtaaccgaccgttccgaaccgg

SEQ ID NO: 265302 - DNA, 613 bp, Homo sapiens
  misc_feature: GYAE6OF01DZCSY.34.26.C04.1.454.CMB.1.raw
  modified_base (289)..(289): a, c, t, g, unknown or other
  misc_feature (289)..(289): n is a, c, g, or t
  modified_base (383)..(383): a, c, t, g, unknown or other
  misc_feature (383)..(383): n is a, c, g, or t
  modified_base (560)..(560): a, c, t, g, unknown or other
  misc_feature (560)..(560): n is a, c, g, or t
  modified_base (578)..(578): a, c, t, g, unknown or other
  misc_feature (578)..(578): n is a, c, g, or t
  modified_base (590)..(590): a, c, t, g, unknown or other
  misc_feature (590)..(590): n is a, c, g, or t
tcagtacacgtgatcacgaccggtgctcgatttagtctagcgactttgggtttggggctgggagaggagcccagcactagagggtcggcggtgtttccattcggtgatcagcactgaacacagaggactcaccatggagtttgggctgagctgggttttcctcgttgcttcttttaagaggtgtccagtgtcaggtgcagctgggtgaggtcgtagggggagccgtggcccaggccctgggaccgtccctgacgacctctctggtcgcagtcgtctggacttcaccttnagtatcatggcattcgcgaccgttcggggcccgcgtacggcctccggaggcggaacggggctagggagtggggtgactagttatagtggttaanggaatgggtaaacgtgtaccaattacgtatcggacagtacgtccggtaggaacgggacctgttacccacggtcctaccgagacgaacaacgtacccgaagtaaaccgcgtacctagttactacgtacgaacctaaatcggacctacgcctaggacgacgtacggacgtagaccggtntacgttagttacgttacnggtcgacggtanaacggacgaacgcgacctaacgg

SEQ ID NO: 265303 - DNA, 742 bp, Homo sapiens
  misc_feature: GYAE6OF01ELA95.34.26.C04.1.454.CMB.1.raw
  modified_base (730)..(730): a, c, t, g, unknown or other
  misc_feature (730)..(730): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggtagtttgggctgagtcgttgggtttttcctcgttgcttcgttttaagaggtgtccagtgtcaggtgcagcgtgggtggtaggtcggtgggggagtcggtcggcccgaggcccgtgggacccgtcccgtagtacgaccttccgttccgtaggtcgacgtaggtccgttcttaggtactttcccaaccgtttcaaggtacgttcaagttggcctaagttcgaccgtacggttccggggtacccgccgtacggtcccttaccggagggtcggtaacggggtcgttaggggtgggtcggggtcgtacgttaaggtttacgtaggttagggtattacggtagtacgggtaaagtacgttactaaattacgatcgacaacggtactacgggagtaaccgggtccgtacttacccgtaccgtacctacgaagtaccaacgtaacctaacccgaaagtaccgtccgtacgttaactagtacccgtacgaaacgtacttacgaaccgttacgaccgtagaaccggcgaaccggacggtaaccgtacgttacgttaacggtttatttaacgaccggttaggacgaaggtacgaacgacggtaacncgtaccgtacgg

SEQ ID NO: 265304 - DNA, 612 bp, Homo sapiens
  misc_feature: GYAE6OF01BDXAU.34.26.C04.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtntccagtgtcaggtgcagctggtggagtcgtgggggagcgtggcccagccgtgggacctcccngacgactctctgngcagctcgtggacttcaccttcgagtagtcatggcagtgcacgtcgggccnccgaggcctcgaggcgaagggctgggaggtcgggtgctagttatagtgtagngagtacggaagtgtacaatactagtgacgtagtaccgtccggtaggacggccgtatccgacgtccgactaacgacgaaccaaccgtaacccgaaacgaaccgtacgtacgttacgtactacgtacgaaacaacgtaccgtaaccgcgtacgtaggaacggaccgacggtacggaccgtaacgggtacctaagttggttaacttcggtggtaacacgggtaaaggacggtaacgacccaaggtaccctacggg

SEQ ID NO: 265305 - DNA, 696 bp, Homo sapiens
  misc_feature: GYAE6OF01B5X3K.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgacgactctcctgtgcagcgtctggattccaccttcagtagtcatggcatgcacgtgggtccnccaggcctccgaggcaaggggctgggagtgggtgcagttatagtggtatgagttggaaagtgtacaaatacgtagtgactaggaccgttccggtaggaacggggtcccgtaagtttccccgaacccggttaccttacccgaacggtaaccgaaacctaaaccgtacccccgaaaaggaaacccgtaccggtaccgttagtaaccgttccgtaacgtaaccgtaaaacgtcgggtaaacccgacgtaccccgttagggaacgtaacgggaccccggtaagggaaccctaaccgggaccgtttaacgtacgttaaacgttttaccggtacgggttaacggaccgggtaacggtaaacggaaaccggaacccgaaacggtcccccgtaaacggg

SEQ ID NO: 265306 - DNA, 843 bp, Homo sapiens
  misc_feature: GYAE6OF01CF6MM.34.26.C04.1.454.CMB.1.raw
  modified_base (514)..(514): a, c, t, g, unknown or other
  misc_feature (514)..(514): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccagtggagtttggctgagtcgttcgggtttttccctcgttgtacctttagttttaaggaggttcgtccgagttgtcaggtgcgagcgttgggtggaggttcggtagggggggacgtccggtcggaccccgaggtcccggttacggggacccgttccccgtagaaccgtacccgtttccgttccgtggtacgccgtacggtcccggttcgttaaggtacctttacctaaccgtttcgaaaggttacgtcgtaagttcggactaagtcggaccgtaccgggtttacgggccccgaccgtacgggtccctaccggaagggaccggaacggggtcggttagggtacggttcggggacgtaacttaaggtttaagtagttagggtanaacggtaggttaggtaaaagttactaagtaaaatttacgagttaccgagtaacggtacccgttaacggtaacgggtaaccggtaccgttaaccgttaaccgtaacccgtaccgtaaccggaaagtaaccgaaaccgtaaacccgtaaacccgaaaacgtaacccgacggttaacgtagtttaaccgcgttaaacgaacgtaaccgtaaccgaaccgacgtaacgacggacgaaccggtaccggaacgaccgaacgttattaacggttaagttacgttacggtacggaacggaagacggaaacgaaccgtaacgaccgtaccgtaacggg

SEQ ID NO: 265307 - DNA, 810 bp, Homo sapiens
  misc_feature: GYAE6OF01ESRQ7.34.26.C04.1.454.CMB.1.raw
  modified_base (161)..(161): a, c, t, g, unknown or other
  misc_feature (161)..(161): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagagtgtcagtgtcaggtgcagctggtggagtcgtgggggagcgtggcccagccgtgggactccctaggacactctcctgtcgcagcgttctggtacttcaccttnagtagtacattggcaagtcgacacgtcgggtaccncctaagggtccctacgagggcgaaaggggtcctgggtaacgtggggttacgctaagttagatagggtacaggagtaggtaaagtacgtactaaaagtaccttagaccgtacgtaagtaacccgttccgggtaaggtaaaccgggtcccgttaacggtttacccgtaaccccgggttaccttaacccggaaaggtaaaccgtaaaccgtaaaaccccgttaaccccggaaaaacgtaaacccgtacccgtaaaccgtttacggtaaaccggtttacttaccgggaaaacccgttaaaaggtaccgtaaaacccgtaaaccggcccgttaaagggtaaaccggggaaccggtacccgggaaaccgggttaaaccggaaaccgggtttacccgttaaagtttaacggttaaccggttttaaaccacggggtttaacgggaacccgggttaaagaaacggggtaaaccggaaacccgtaacgggttacccaaacccggg

SEQ ID NO: 265308 - DNA, 895 bp, Homo sapiens
  misc_feature: GYAE6OF01D2L6J.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgagtcgttgggttttcctgttgtcttcgttttaaggaggtcgtccaggtgtcgaggtagcagcgtgggtaggtagtcggttggggacggtcgtcggcccaggtcccgtgggacctccgtgacgtcctctcgtgtcgcacggtccgttcgtaggtaactttcccgtaccttacgtaagttagtccaagtgggcctaagtttcggaaccgtaccggggtttccggggtccccgaccgtacggggtaccctacccgggaagggacccgggtaaaggggggttcctaggggggtacgggtttgggggacggtacgttaaggtttaatagggtttacgggtattagggaaggttaagggtaaaacgttagttaacctaaaagttacgtagtacgggtactaaacgggttcccggttaccgggtaagggtaacccggggtaacccgtttacgtttaaccccggtaacccgtttaccgtaaccggtaacggaacccgtaaacctaacccgtaaaccccggtaaaacgtaacccgtacggtacgtttaacgtagttaccggtaaacgtaacgttaaaacggtcccaaaccggtccgtaaccggtagggaacccggtaaccgggaacccgggtaaacggaacccgggtggttaaacccgttaagggtttaacggttaacgtttaaacccgggtggtacggtaaaccgggtaaacggaaaccgggtaccgtaaaaccgtccgtaaaccccgggtacgg

SEQ ID NO: 265309 - DNA, 950 bp, Homo sapiens
  misc_feature: GYAE6OF01EMHC8.34.26.C04.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagtacacgtgatcacgaccggtgctcgatttagtctagcgactttggggtttggggctgggagaggagcccagcactagaggtcggcggttgtttccattcggtgatcagcactagaacacgagacgactcaccagtgggtagtttgggctggacgtcgtttcggttttcctcgttgtctttacgttttaaggnggttcgtacctaggttcgtacgagggtncgtaggtcggttgggagggtacggttgggggtgggggggtaccgccgggtcccggaccccgaggggttaccccggttcgggggtaccccttcccgtaacgggaaccgtttaccccgttccttaccgggttgggttaccgacggtccggttccggttaacggtacccggtttactttacccgtttaacccgttgttaaccgggttataccgtaggttaccgacgttactcggtaaccggttcggggtcccgggtcccgaccggtaccggacccggtacgggaaccggggtacgggtacggggtaccggtaggggtacgggttggggaacgttaccgtttaaggtttaacggttaggtagggttaacgttaaggttaaggtaagggttaacggtactaacgttaaaactacggttatacggtacccggagttacccggggtaccggtaacgggaaccggttccgttaacggttaccgtacccggttaacgaaccggtaacgtaaccaaccgtaaacctaaccgtaaacgactaaccggtcttacggtactaacggttaacgaaccgtaaccgaccggtaacgtacgtacccggaacggaagggtacccgggacgtaaaccgggtctaaaccgggttctaaacggtttaggttacccggttaaaccggtagggttaccgaaacggtaacgggtaacaccggttaaacccgcccggttaaaccgtcgggg

SEQ ID NO: 265310 - DNA, 735 bp, Homo sapiens
  misc_feature: GYAE6OF01BKPHR.34.26.C04.1.454.CMB.1.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttggctgagcttgggttttccagtttgccttcttttaagaggtcgtccagtgtcaggtgcagcgtggtgaggtcgtgggggagcgtggcccagccgtgggacctcccngacgtactctcctgtgcngcgtcgtggtacttccgacttgaagttcgtcagtcggcaagttcgaccgtaccggttcggggtacccaccggtaggccctacggagggaccggtaagggggtccttagggggaggttcggggtcgtacgtaaggtttagtaggttagggtactagggtacgttaacgggtaaagttacggtactaaacgttacttacgtcggaaccgtaacgtacccggttccgggtaaggtaaccgggtaccgttacgttacccgaccccggttaccgtaacccgaacggaaccgtaaccgtaaaccgtaaccccgaaacgaacccgtaccggtcgttacgttaaccgtcgtacgtaactaacgtaccgtaaccgacgttacccgaggaccgtaacggaccggaaccgtaccgacggttactacggttacgttaattccggagtacgaaggacgtaacggaacaccgacggtaccgacgg

SEQ ID NO: 265311 - DNA, 541 bp, Homo sapiens
  misc_feature: GYAE6OF01BZVCX.34.26.C04.1.454.CMB.1.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggcccagcctgggacgtccctgagactctcctgtgcagcgtctggattcaccttnagtagtcatggcatgcacgtgggtcccnccaggcctccgaggcaagggggctgggacgtggggtggctagttatagtggtatgatgggaaagttagtcaatactagtgcagactcgtgaacgggccattcaccgtctccagacgacaactcccaaagaaccacgctagtactcgtgacctaaagtcgaaccagccctaggacgacgccggaaggaccgacggtctagttagtacttacgngtagcgagagagacagcctaacg

SEQ ID NO: 265312 - DNA, 773 bp, Homo sapiens
  misc_feature: GYAE6OF01C90CK.34.26.C04.1.454.CMB.1.raw
  modified_base (190)..(190): a, c, t, g, unknown or other
  misc_feature (190)..(190): n is a, c, g, or t
  modified_base (516)..(516): a, c, t, g, unknown or other
  misc_feature (516)..(516): n is a, c, g, or t
tcagtacacgtgatcacgaccggtgctcgatttagtctagcgactttgggtttgggctgggagaggagcccagcacgtagaggtcggcggtgtttccagttcggtgatcagcactgaacacagaggactcacagtggagtttcggctgacgtcgttcgggttttcctcgttcgctttacgttttaaaggnggtcgtaccgtaggtcgtacgaggtcgacgagtcggtggtaggtggttcgggtggggacgtccggtccggccaggtccggtacgggtacctccgtagacgtaccttcgtccgtggtcgaccgtacggtccttaggtacgtaccttaccgtaccgtttagacggttacgccgttaagcggcctaagttccgacggtaccggttccggacccaccgtacgtcccgaaggtacggacggtagggtcgtgggtaccgggtggtacgtactaaaggtttagagttagtaggtaagtaaggtacggtaagtaactaacgtaactacggttancggaaacgtaccgtcggtaacggtcgaacgggttacccacgttacccggtacgtaccgtaacgtaacgaaccgttaaccgaaccgttaaccggaaaactaccgtaacgtacgttacgttaccaacggttaacaaaccgtaacggtaccaccgtacgtacgaacgtaccgaacgtacgggcgtaaacgtataacgttacgtacgttaggtaccgtggaaacgacggaagtaccgtaacgcgaaacgtcccgtaacggg

SEQ ID NO: 265313 - DNA, 871 bp, Homo sapiens
  misc_feature: GYAE6OF01CVFUZ.34.26.C04.1.454.CMB.1.raw
  modified_base (199)..(199): a, c, t, g, unknown or other
  misc_feature (199)..(199): n is a, c, g, or t
  modified_base (568)..(568): a, c, t, g, unknown or other
  misc_feature (568)..(568): n is a, c, g, or t
tcagtacacgtgatcacgaccggtgctcgatttagtctagcgactttggggttggggctgggagaggagcccagcactagaggtcggcggtgtttccattcggtgatcacgccactgaacacagaggactacacctagtggtaggtttggccttgagtcgttcgggtttttcctcgttcgtccttaccgttttaaaggngggttcgtccgtaagttcgtacgagggtcgaccgaaggtcggttaggggtcggacggttcgggtggggggaacggtccggtacggacccggaggtcccggtagggtaccgttcccgagacgtaccttccgtcgtggcgaccgagtccgtcgtaccggtcttaccgtacctttagtaagttacgacgtaagcggactaggtcccgaccggttaccgtccgggaccccgccggttacgcccgtacggaggtacgggacgggttcggcggggtaagggttcgggaccgttaagtttaacggttacgtaggtaaacggttagtcggtaaggtttacggtaaaaggttacgtaacgtttaaacctcgggttaanacccggaacggttaacgggttcccggaccgggttaagggaaccgggttaccgttaaccgtttacccgtaaaccgtccgttaaccggaaagtaaaccaaacccgtaaccgaaaccggtaaaccgaacgttaacccgtagttacgtaccgttaacgtaccgaacggttaacggaaaccgccgtacccgtaacgtccggaacggtaccggagtaacccggaccgtaccggtacgttaacgttaccgttagtcggtccggtaagtaccggaacggtaccaacccggtccgtaacgccccttacgggg

SEQ ID NO: 265314 - DNA, 724 bp, Homo sapiens
  misc_feature: GYAE6OF01BFX1J.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctccctgacgtacctctccgtgtcgcagcgtctggattccgaccttcagtagtcagtggcatcgcctacgtcgggtcccgcgacggcctaccgagggaccggaaggggtcctaggggtaggtggggtcggacttaggttaacgtagttcgggtaatcggagttagggtaaagttagtactaaagttacgttagtacggactaacggtaccgttaccgggtaagggaaacccggggtaccttaacgtttacccgaacccggttcctaccggaaaggtaaccggtaaaccctaaccgttaacccggaaaacgtaacccgtccgtaaccgttagtaaccgttacgtacgtaaccgtaaacgtccggaacccgtacggtaccgtaacgggaacgtacccgggaccggtaacggaccggtacggtaccttaagtaccgttaagttccgtagtcggaacgtacgtacgaacgacgccgtacccgtaacggg

SEQ ID NO: 265315 - DNA, 870 bp, Homo sapiens
  misc_feature: GYAE6OF01CGHUC.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctgagtcgttgggtttttcctcgttcgtcttacgttttaaagaggttcgtccgagttgtcgaggtgacagtcgtggtggaggttcggtgggggacgcggtcggcccgacggccgtacgggaccgttcccgtaggacgtaccttcctccgtggtcgcgagtcgtcgtaggtacttcctaccgttacgagttacgtctagtcggtactagtcggccgtaaccggttcggggtccccgaccggtaacgggtcccgtacccggacggggtaacgggaaacgggggtccgtaggggtaagggtcggggtggtacttaaggtttaacgttaggtacgggttaagtaggtaaggtttacgggaaaagggtttaccgtaaacgtaacgtttaacgtaacgttcgggaacgtaacggtacccgggttacgggttaagggtaaaccccgggggtaccttaaaccgtttacccgggtaaccccggttaccgtaaccggaaacggttaaccggaaaccctaaaacccgttaaaccccggaaaaggtacccgtaaacggtccgtttaacgttaaccgtacgtagaaaaccgtaacggtaccgtaacccgacgtaacccggtaggacggaaacggtaccggacggtaccgtaacggttcgtaagtttacgttaacgtttacggtacggtaacggacggtaaaggacgtaaaccggactaaccggacccgttaaccggg

SEQ ID NO: 265316 - DNA, 773 bp, Homo sapiens
  misc_feature: GYAE6OF01ERYJZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgacgacctctccgtgtcgcagcgtctggtattcaccttcgagtagtctagtcggactagtcgtacctacggtcggggtcccgccgacggcctcccgagggaccgaagggggtctaggggtaggtggggtacggaccgtagttagtagtaggtatacggtagtacgggtaagtacgtaacgtaaatacgtaacgtagtaccgtaacggttacccgtaccggtaaggggtaaaccgggtccgttaacgtttcccgtaccccggttacgtaacccggtaaggaaaccgtaacccgtaaacccgtaccccgaaaaccgtaaccgtaaccggtcgttacgtttaacgtacgtaaccggtaactaaacggtaccgtaaaccccgtaggtaccctaagggaccgaaccgggacccggaaacgggtaacccgaacggttaaccgttaacggttacggttttaaaccttcgggttaacggtacgggtacccgggaaggtaaccggaaacgggacccgtaaacccgggtaccctaacgggg

SEQ ID NO: 265317 - DNA, 633 bp, Homo sapiens
  misc_feature: GYAE6OF01EHFL3.34.26.C04.1.454.CMB.1.raw
  modified_base (221)..(221): a, c, t, g, unknown or other
  misc_feature (221)..(221): n is a, c, g, or t
  modified_base (405)..(405): a, c, t, g, unknown or other
  misc_feature (405)..(405): n is a, c, g, or t
  modified_base (519)..(519): a, c, t, g, unknown or other
  misc_feature (519)..(519): n is a, c, g, or t
  modified_base (531)..(531): a, c, t, g, unknown or other
  misc_feature (531)..(531): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttacgttttaagaggtgtccagtgtcgaggtgcgagcgtgggtggacgttcggnggggggacggcggtcggcccaggccgtgggaccgtcccgtgacgtacctctccgtggtcgacgacggcgttctaggtacttccaccttcgaagtcgtcagtcggctagtcgcaccggttcggggcccgaccgaggcctacgagggcgaaggggctgggaggtgggtgactagttatagtggtangtagtaggaagtagactaaagtactagtcgacaagtaccgtcgtaggaacgggtcctaagttccgtaccgtacgaccgaaggaacgaaccgtaacctacccgaaagaccacgtntacggtctacgnaacgtaactacgaacgacgacgtagacggacggaccgaggacgacgttacgtagttagtaagttcgtggtgacgggtaagacggaacgacacgtccgaacgg

SEQ ID NO: 265318 - DNA, 741 bp, Homo sapiens
  misc_feature: GYAE6OF01BE3D3.34.26.C04.1.454.CMB.1.raw
  modified_base (164)..(164): a, c, t, g, unknown or other
  misc_feature (164)..(164): n is a, c, g, or t
tcagtacacgtgatcacgaccggtgctcgattttagtctagcgactttgggtttggggctgggagaggagcccagcactagaggtcggcggttgtttccattcggtgatcagtcactgaacacagaggactcaccatggagtttggctgagcttgggttttccngttgcttctttaagaggtcgtccagtgtcaggtgcagcgtggtggaggtcgtagggggagtcgtggcccgtaggcccgtgggtaccgttcccgtaggacgtaccttctccgtgtcgctaggtcgtcttaggtactttccgacctttcgaacgttacgttaccaagttcgggacctaaggtcgaccgtacggttcgggtcccgccgaacgggccctaccggagggcgaaaggggtcctaggggaggtcggggtacgacgtaagtttactaggttaggtagtcggaagtttacgggaagtaagtcaaacgttctagtcggaactacgtaccgttcggtaacggaacgggtcctacgttacccgacgtacctaccgtaaagaacccggtaactaacgtacccgtaaagaacccgtacgacttaagtactcgttacgaacgaacgtcgtaaccacgccgttaacggagtaacggtaccggacggtaaccgaaccgggttattacccgttagtttaaccgtacggttacgtacggaaccggtaacggtacgtaaccggacccgtaccgttaccgtaaccggg

SEQ ID NO: 265319 - DNA, 792 bp, Homo sapiens
  misc_feature: GYAE6OF01COY8A.34.26.C04.1.454.CMB.1.raw
  modified_base (741)..(741): a, c, t, g, unknown or other
  misc_feature (741)..(741): n is a, c, g, or t
  modified_base (778)..(778): a, c, t, g, unknown or other
  misc_feature (778)..(778): n is a, c, g, or t
  modified_base (782)..(782): a, c, t, g, unknown or other
  misc_feature (782)..(782): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaaccagtggagtttgggctgagtcgttgggtttttccctcgttgtcttacgttttaaaggaggttgtacctaggttgtcgaaggtgacgtagcggttgggtaggacggtcgggtaggggggacggtccggtacggcccacggtccgtcggggtaccgttcccgtggaacgaccgtttccgttccgtggtcgtaccgtacggtccggttccgttaggtaacctttcccgtaaccgtttcgaaggtttaacgtccgtacgttcggactagtaccgtccggtaccggttcgggcccgtaccggacgccgtacccgagggacgggaacggggtggtacgggagggtcgggttagacgttaaggttacgttaggtaagggttactagggtaacggtaaggttaacggttattaaaccgagtttaaacacggtcgaacgtaacgtaccggtaccgggtaacgggtacgggtaccgtacgttaccgtaacccgttacccgtaacgaacgaaccgtaacccaaaccgtaacccgaaaagaccgtaaccgtcttacgtaactcgtaaacctaagaaccgtacgaccgtagtccgtaacggagtaccggacgtacggaccgngtacgtacttaagttctaggtcgatacggataacganacgngacgtaacgg

SEQ ID NO: 265320 - DNA, 755 bp, Homo sapiens
  misc_feature: GYAE6OF01AZ2PQ.34.26.C04.1.454.CMB.1.raw
  modified_base (289)..(289): a, c, t, g, unknown or other
  misc_feature (289)..(289): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtggcccaggccgtgggaccgtcccgtgacgaccttctccgtgtgcagcgtctggacttccaccttnagtagtcagtcggcatcgcctacgtcggggtcccgaccagggccctaccggagggccggtaaagggggcgttaggggacgggttggggtacggacttaaggtttaactaggttagggttaagttggaaggttagggtaaagttacgtaactaaattacgtaagtcgacgtaacggtaccgttacgggagggtaaaccgggtccgtacgtttacccgacccggttacctaaccggaaagtaacccgaacctaaaccgtaaccccgaaaagaacccgtacgtacttaacggtacttacggtaacgaacctaaacgtaccggtaaacccgtaggtacccgtaaggggaaccggaaccgggacccgggtaaacgggaaacccgtaacccgggtaactttacggtaggttttaaccttacggtcgggtaacgacggaaagggtacaacggtaacgccgtaccctaacgggg

SEQ ID NO: 265321 - DNA, 769 bp, Homo sapiens
  misc_feature: GYAE6OF01DBLGI.34.26.C04.1.454.CMB.1.raw
  modified_base (742)..(742): a, c, t, g, unknown or other
  misc_feature (742)..(742): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcacagtggtagtttgggctgagtcgttgggttttcctcgttgtcttacgttttaaggaggtgtccaggtgtcgaggtgcaggtcgtgggtggaggtcggtggggggacgcggtcgggcccgaggtccggtcgggtaccgtcccgtaggaacgtcctccgtccgtggtcgccgtacggtccgttcgttggtaacttccgtaacccgttgtaacggttaacgtccagtcgggacctaagttcggaccgtaccggttccggggtccccgaccggacggtcccgtaccggaaggggaccgggtaaacgggggtggttaggggtacgggttggggtacggtagttaaggtttaagttaggtaggtagtaggtaaggttaagggtaaagtacgtacgtaaaagttactagtacggaacgtaccgttacgtacgggtaacgggaaccggtaccgtacgttacccgacccgttacgaaccgaagaactaactaaccgtaaccgaacgtaacctcggtacttaggtactacgataaccgacgtacgaaccgacgtacgaggaccgaaccggcggaacgtaccgacgtaagttacggtgttaactcgtcggtaacgacgggtaanaacgacgtaaccgcgaacccggtacgg

SEQ ID NO: 265322 - DNA, 821 bp, Homo sapiens
  misc_feature: GYAE6OF01CVNEZ.34.26.C04.1.454.CMB.1.raw
  modified_base (168)..(168): a, c, t, g, unknown or other
  misc_feature (168)..(168): n is a, c, g, or t
  modified_base (362)..(362): a, c, t, g, unknown or other
  misc_feature (362)..(362): n is a, c, g, or t
  modified_base (772)..(772): a, c, t, g, unknown or other
  misc_feature (772)..(772): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcgttggttttcctcgttncttacgttttaagagtgtccagtgtcgaggtgcaggcgtggtggtaggtcggtgggggacgcgtcggacccgtacggcccgtacgggtaccgtcccgtgacgtaccttcctccgtgtcgcgagtcgtccgtagtactcctaccgttcgagttacgctaagtcggactacgcgaccgtacggttccggggacccnccgtaccggtacccgtaccggagggacccggaaggggtcgtcggggtagggtcgggtacggtagtagtttaagttacggtaggttacgtaggtaacggttaagggtaaacggttagtaaccgtaagttaccgttaaggcggttaacctacggttacccggtacggtaacggggtaccggttaccgttacttaccccggttaaacgtcccgtaagaacgtaacctaaaccgtaaccccgtaaaccgaaacgaccgtacgtacccgttagttaaccttagaacgtaaacccgtaaacgtacggaacccgtaaccggtagttaaccgggacggtaaccgggaaccgggaaccggtaccgtaaaccggggtttctaagggttttacgtttaaacgttaacccgggtggggttanaaacgggaacggaacgtaacccgtacggaacccgtaccggttaaccggg

SEQ ID NO: 265323 - DNA, 729 bp, Homo sapiens
  misc_feature: GYAE6OF01A3AN1.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatgggagtttgggctgagcttgggttttcctcgttgcttcttttaagaggtgtccagtgtcaggtgcagcgtgggtggagtcgtgggggagcgtcggcccagccgtgggacctcccgtgacgaccttctccgtggtacgcaggtcgtcgtggacttccaccgtttcgagtagtcagtcggctagtcggacctcggtcggggtccccgaccgacggtcctacccggaagggcgaacgggggtctggggaacggttgggtcggactaaggttataggttacggtataggtaagttagggaaagttacgtactaaaagttaccgttagtaacggacaacggtaccgtaccgggtaggtaacgggtcccgtacgttcccgtacccgttacgacccgtaaggaaccgtaacctaaccgttaacccgaaagtaccgtaccgtctttaggtaactcgtacgaactaacgtcgaaccggacttccggaaggaacggccggtaaccggacggtaaaccgacggtacgttaacgttaggtttaacttccgggtaagtacggaacggtaaacgtaaccggaacgaacccgtaccggccgttaaacggg

SEQ ID NO: 265324 - DNA, 711 bp, Homo sapiens
  misc_feature: GYAE6OF01C0PS9.34.26.C04.1.454.CMB.1.raw
  modified_base (576)..(576): a, c, t, g, unknown or other
  misc_feature (576)..(576): n is a, c, g, or t
  modified_base (592)..(592): a, c, t, g, unknown or other
  misc_feature (592)..(592): n is a, c, g, or t
  modified_base (621)..(621): a, c, t, g, unknown or other
  misc_feature (621)..(621): n is a, c, g, or t
  modified_base (704)..(704): a, c, t, g, unknown or other
  misc_feature (704)..(704): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagttgggctgagcgttggttttcctcgttgcttcttttaagaggtgtccagtgtcgaggtgcagcgtggtggagtcggtgggggagcggtcggcccgagccgtgggaccgtccctggacgtacctccgtccgtggtcgacgagtcgtacgtggtacttcctaaccttgaagtcgtacagtggactagtcgccgtaccggttcgggcccgccgaggtccgaccgagggacgaaggggtgttaggggtacgggtggggttacggacgttaacggtttagtacggtagggtttaacgtggtaagtttaagggaagttaacggttaaccttaaagtaccgtagtacggaccgtaacggtaccgtcggttaacgggacgggttaccctagtttaccccgaccggttacctaacgtaacgaacaacccgttaaccaaccccggaaanacccgtagtaccgttntacgcgttaaagactaaacgtacgtaccncgacgtaaggaccgtacggaacggacgacgtacgtacttagtagtttacctcgggtagtgacgtaacgagaccgaactcccgngtaacgg

SEQ ID NO: 265325 - DNA, 783 bp, Homo sapiens
  misc_feature: GYAE6OF01A471U.34.26.C04.1.454.CMB.1.raw
  modified_base (182)..(182): a, c, t, g, unknown or other
  misc_feature (182)..(182): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaagaggtntccagtgtcaggtgcagcgtgggtggagtcggtgggggagcggtcggcccaggcccgtggggacctcccgtggaccgtacttcctccgtgtcgacgtagtccgtgtcggtaattccaacctttgtagtaacgtcctaagtcggactagtacggtcctaccggttcgggtcccgaccgtacggccgttacccgaggtaccggtaaggggtcgtggggtaacggttcggggtacggtacttaggtttaagtacggttggtagtaggtagtaagggtaaacgttaggtacctaaagtacgttacgtacggaactaacggttacccgtcgggttaacgggaaccggggttaccttaacgtcccccgggtaacttacccgaaccccggtaaaggaacccggttaaacctaaccggttaaaccccccggaaaagtaacccggaccgtaacgtttacggtaaccttcggtaacgtaaacgtaaacgtcccgaaccgtaggtaccgtaaggacgtaccgaccggtaaacgtcggaaccgttagtacgtttagtaacttcgggtgtaacccggaggttaacggaacgacgtaccgacggccccgttaagg

SEQ ID NO: 265326 - DNA, 690 bp, Homo sapiens
  misc_feature: GYAE6OF01AIC4P.34.26.C04.1.454.CMB.1.raw
  modified_base (185)..(185): a, c, t, g, unknown or other
  misc_feature (185)..(185): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagtcgttgggttttcctcgttgtcttacgttttaaggnggtgtcctagttgtcaggtgcagcgtggtggagtcggtgggggagcgtcggcccaggcccgtgggaccgtcccgtgactcctctccgtggtcgctagcgtctggacttccaccttcagtagtcagtggcagtcgctacggttcgggccgtccgacggtcctaccgaagggcgtaaacgggggcttagggaggtcgggtggactaggttaagtcgttgggtaatcgtaaggtagggaaacttacgtaacgtaattacgtagtgacgtaacgtccgtcggtaaggtaaccgggtacctacgttacccgtacccgtcgtaccgacggtaacgaacctaaccgtaacccgaaagtaacccgacggtactaggttacgtaccgtagtaactaacgtacgaccgtacgtaccgtaggaaccgacggaacggacggaaccgacggtacttaagtccgtttaagtcgttcggtacggacgtaacggacgaaacgacgtccgtaccgtaaccgg

SEQ ID NO: 265327 - DNA, 653 bp, Homo sapiens
  misc_feature: GYAE6OF01AU5NM.34.26.C04.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgcgttaggctctttaagaggtgtccagtgtcaggtgcagctggtggagtcgnggggagcgtggcccagcctgggactcctgacgctcncgtgtgcagcgtcgtgacttcaccttcagtgtcatcggcatcgcagtcggtccgcaggctccgaggtcgaagggctagggcgtgggtgctagttatagtcggtatggagtcggaagtagtactaagtactagtcgcgaagtaccgtaccggtaggaacgggaccgtactttacccgaccggttacctaccgtaaaggaaccgaacctaaaccctacccggaaacgaaccgtacgtacgttacgttaacgtccgtaagaacctaaacgtaccgaaccctagacccgttagggaaccgccggaaccggaggtacccggtaccggtagttaacgttacggtttaaacgttacgtacggttacggaacggtaacgaaggggaacctaccggtaaccgcccgttaaaccggg

SEQ ID NO: 265328 - DNA, 800 bp, Homo sapiens
  misc_feature: GYAE6OF01CDTMT.34.26.C04.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (454)..(454): a, c, t, g, unknown or other
  misc_feature (454)..(454): n is a, c, g, or t
  modified_base (671)..(671): a, c, t, g, unknown or other
  misc_feature (671)..(671): n is a, c, g, or t
  modified_base (760)..(760): a, c, t, g, unknown or other
  misc_feature (760)..(760): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtgtttgggctggagtcgttgggtttttcctcggtttgtcttcgttttaaagnggttgtccctagttgtcgaggtncaggtcgtgggtggagttcggaggggggacgcggtcggacccgaggtccggtcggggtaccgttcccgtaggaaccgtcctttccgttccgtaggttcgacgcggtccggtttacgtaggttaaccttttcctaaccgtttaccgtaaggtttacgtactaaggtcggcttaacggttcgaccggttaccggtccggggtcccaccggtacgggtccctaccgggtaggacggtaacggggngttaaggggtcggttagggtccggttagtaaggttttataaggttagggtttaaggtagggtaagttacgggtaaacggtttaacgtacggttaaaacctttagtaccgttagaacggtacccgtacggttaaccgggtagggtaacccgcggtttaccgtacccgtcgttaccgtacgaacggaactaaccgtaacaccgtaaacgaccgttacgngttaacctgtaacttgaacgtaacgctaccgaagttccgaaggtaccaggaccggacgtaccggtagttacgtagttacggtacttagnggtaaccggagagtacggaccgaggaacccgtggtaacgg

SEQ ID NO: 265329 - DNA, 818 bp, Homo sapiens
  misc_feature: GYAE6OF01C8IML.34.26.C04.1.454.CMB.1.raw
  modified_base (764)..(764): a, c, t, g, unknown or other
  misc_feature (764)..(764): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctggagtcgttgggttttcctcggttgtccttcgtttttaaggaggttcgtcctagtgtcgaggtgcagcgtgggtggagtcggtgggggacgcggtcggacccaggccgtggggaccgtcccgtagacgtccttccgtccgtggtcgcgacggtcgttccgtaggtacttccctaccttgaacggttcggtaccagttgggacctaagttcggaccctacggttccggggtaccccgaccgtacggcccgtacggacgggaccggaagggggtcgttaggggtaggtggggtacgacgtaagtttagtaggttgggtaagtcggtaagtacgggtaaagttagtaaccgtaaagtaaccgtagcggtaacgacggttaaccgtcccgggtaagggtacccggtaccgttaacttaccccgtacccgttaccgtaaccgaaaggtaaaccgaacccgtaaacgtaacccccgaaaaagaacccgtaacccggtacgtaagggttacctaacggttaacgaaaccgtaaaccgttaccggaaccgtacgtacggtaacggaacgggaacgtaccgggaaaccgaccgttaacggtaactttacggtaagttactttaacggnggtaaaccggacggaaacggtaggtaaaccgaaccggcctacccggtaaccggg

SEQ ID NO: 265330 - DNA, 857 bp, Homo sapiens
  misc_feature: GYAE6OF01DV2XL.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggaggcggtcggcccaggccgtgggaccgtcccgtggacgtacctcctccgtggtgcaggtccggtcttagggacttctaccttcgagtacgtcagtggccagtcgactacggtcgggtcccgaccgtaggccctccgaggggaccgaagggggtcgtggggtacggttggggcggtacgtaggtttaagtacgtagggttagtacggagttacgggaaagttacggtaaccgtaaaattaccgttaagtacggtaccgtaacggtaccgttaccgggtaacgggaaccgggggtaccccgtaacgtttacccggtaaccccggttaccaaccggtaaggaaccggtaaccgtaaaacccgttaaccccgaaaacgtaaaccctaccggtacgtttaacggttacgtaaccggttacgtaaaccgtaacgtaacccggtaacccgaaccggttaccgtaaccgggacggaaacccgggtacccgggaaaccgggtaacccggtaaccgggttaaccttaaacgggtttaaggtttaaccgtttacgggttaaacggggttaccggtaaaccggggtaaacggtaaaccgggaaaccggtaaacccggtaaacccggtaccccggttaaaaccccggggg

SEQ ID NO: 265331 - DNA, 967 bp, Homo sapiens
  misc_feature: GYAE6OF01ETWKI.34.26.C04.1.454.CMB.1.raw
  modified_base (182)..(182): a, c, t, g, unknown or other
  misc_feature (182)..(182): n is a, c, g, or t
tcagtacacgtgatcacgaccggtgctcgatttagtctagcgactttgggttggggctgggagaggagcccagcactagaggtcggcggtgttccattcggtgatcagcactgaacacagaggactcaccatggagtttgggctgagcttgggttttcctcgttgcttcgttttaagaggtntccagtgtcaggtgcaggcgtggtggagtcggtgggggaggcggtcggacccgagtccgtgggaccgtcccgtaggacggtcctccgtccgtgtggaccaggtccggttccgtagggtacctttccgaacccgtttcgaagttacggtactaggttcgggtctaacgttcggacccgttaccgggttcgggggtacccccgtaccggaacggggtccccttaacccggaagggggaccggtaaaacgggggggtccgttaggggggttaacggggttccgggggtagggttaccgtaaggggttttaaattaacggggtttcgggttaaagttagggtaagggtaaacggggttaaaacggtttaacggttaacgttaaaaccgtaacgtttaacgggtcgaaacccggttacggggttaaaccccgtttccgggtaaccggggtaaaccgggttaccccggttaacctttccccgggaacccggtttccctaaacccgggaacgtaaccggtaaaacccgtaaacccgtaaaccccggaaaaacgtaaccccggtacgtaacccggttttaacgtaaccgttacggtaaacttaaacccggtaaaaggtcccgaaccggtaaccggtacgtaaccggggaacggtaccgggaaacccggtaacgggtaaacccggtcggttaaacggttcgtttaaacggtttacggttaaccggtcgggttaaacggaccgggtaaaacgggaagtaaaccccgggtacctaaccccggaccgttaacccggg

SEQ ID NO: 265332 - DNA, 691 bp, Homo sapiens
  misc_feature: GYAE6OF01CTKAY.34.26.C04.1.454.CMB.1.raw
  modified_base (281)..(281): a, c, t, g, unknown or other
  misc_feature (281)..(281): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagtcgttgggttttcctcgttgcttcgttttaaggaggttgtcctagtgtcgaggtgcgagtcgtggtggagtcggtgggggacgcggtcggcccgaggccgtagggaccctcccgtgacgtacctcctccgtgngcgagtcgttcgtaggtacttccgtaccttagagttacgtgagtcggactatcgaccgacggttccgggtccccgccgtacggccctaccggagggccggtaaaggggtcgtaggggtacggttggggtaccgtacttaggtttaagtggtaggtagtaggtaaggtggtaaagtaggttaactaaagttactagtgacgtaagtaccgtacggtaggaacggccgttacgtaccgaccgttcctacgaagacgaacgaaccgaccaacgacacgtctagtactacgaacgaacgtaacgttacgacgttacgacgtacggaggacgtaccggaggtacccgaggttgtaacgttagttacgttacgtagtacggagtaaacggtacgaagtaccgtacgccgttaccgg

SEQ ID NO: 265333 - DNA, 640 bp, Homo sapiens
  misc_feature: GYAE6OF01C0VRN.34.26.C04.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
  modified_base (350)..(350): a, c, t, g, unknown or other
  misc_feature (350)..(350): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagtctgggttttcctcgttgcttacgttttaaagnggtntccagtgtcaggtnctagcgtggtcggagtcgtggggggacgcgtggcccgagccgttagggaccgtccgtgaccgtcttctcctaggtnctacggtcgtctaggacttcccacgttacgtagtacggtcctagtcggctatccgacgtacggttccggacccncgaacgcctacggaggaccgagggtcgtagggaggtcgggncgttaagtatagagtanagagtcgaaggtnaacgttacacgttagcgacgtacgcgtaccggtaggtacggaccgttacgtaccgaccgtacttacgacggttacaacgtaaccgtaccgaaacgactacgtcctagtacncgttaanacgtacacgacgacgtacgacgacgcgaccggagaaccgagtaccgtagttacgtaccgtgtaccgtacgacgtaacgacgaacgactacgtccctaaggg

SEQ ID NO: 265334 - DNA, 731 bp, Homo sapiens
  misc_feature: GYAE6OF01CVVWT.34.26.C04.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccagtggtagtttgggctgagcggtggtttccgcgtagcttacgttagaggtgtcagtgcaggtncgagngtgggtgcggtggtgggggagtcgnggccgacgcgtacgggctccgagacgtactccgtcncggtnacgngcgtcgtaggtacttctcctanaagtttcgcgagtccggtntagtggtccgtacggttccggcccgacgtcggacccgtggaacggtaggacgggcggtggggtagtcgggtatagttaagttagtaggtacggtagagtaggtaaggtaacgttacgtaactaagtttacgtacggacgtaccgtacggtaaccggttacggtacgggtaaccgggttacgtaccggtacccgttcccttaccgtaacgaacgaacgtaaccgtaaaccgaaccgaaacgaccgtaaccgttaccgtaagtaccgtaaccgtaacgtaacctaaccgtaccggtaacgaccgtaaccgggcggtaaaggaccgaaccgggtacggaaccgtaacggttagtaacgttaacgtagttaccgtaggaaccggaacggtaacggaacgaaggacccgaccgtacccgaacgg

SEQ ID NO: 265335 - DNA, 826 bp, Homo sapiens
  misc_feature: GYAE6OF01DZ7QD.34.26.C04.1.454.CMB.1.raw
  modified_base (205)..(205): a, c, t, g, unknown or other
  misc_feature (205)..(205): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttcggttttcctcgttgtcttacttttaagaggtcgtacctagtgtcgaggtnacgtagcgttgggtaggtggtcgggtaggggggagtcggtccggacccacggtcccgtacggggtaccgttccccgtaggtacgtaccttccgtccgtgtcgaccgtagtccgttacggtaggtacctttcccgtaaccttacgtaagttacgtacaggtacggctagtcggaacctccgggttcggggtacccgacccggacggtacccgtccggaacggggccggaacgggggtgttggggaaggtttacgggggcggtacttaagggtttattaaggtggtaagttagggtagttagggtaaagttaacgtactaaaagtcgttaagtccggtaactaaacgtaccggtacggtaacggaaccgggtaccgttaacgtccgtaacccgtcgtaaccgtaagaaaccggtaaccaaacccgttaaccgaaaccggaacgtaaccgtacgttcgtaattacccgaaggtaacctaaacggccgtaaacccgtacgccgttaaagggacgaaccggaccggaaacgtccgtaaaccggttcgtaaagtttacggtttaacgtcgttaacggtcgggtaaaccgaagtaaaccgtacgaaccggccgtaacccggtaacggg

SEQ ID NO: 265336 - DNA, 755 bp, Homo sapiens
  misc_feature: GYAE6OF01EQSM8.34.26.C04.1.454.CMB.1.raw
  modified_base (253)..(253): a, c, t, g, unknown or other
  misc_feature (253)..(253): n is a, c, g, or t
  modified_base (657)..(657): a, c, t, g, unknown or other
  misc_feature (657)..(657): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaaccatggtagtttgggctgagcttgggttttcctgttgcttctttaagaggtgtccagtgtcgaggtgcagcgtgggtggaggtcgtgggggagcgtcggcccaggccgtgggaccgtcccgngacgcctctccgtgtcggctaggtccgttcgtacggtacttttacccgaccttttcgaaggttacgtacagttcggacctaagttcggtaacctaccgggttccggggttcccccgaccccggtaaggggtccccttacccggaagggggaccggtaaacggggggtctaggggtacgggttggggtaccgtcggtaaagttttgtaggttggtataggagttaggtaaagttacgtaactaacgttaactaggtataccgaaggtccgttacgggacggtaacgggccttacttacccgggacccttaccgaccggaagtaaccgacctaaaccgtccccgaaaataaccgaccgttactaagtttaccagtaacgaacgtaagaccgtaacccgagtaccgnggtaaacggcggtaacggacggaccgacggtacgtattaaggttactaggttacgtaggaaccgtagggaaactaggaacccgtacgcccgtaaacgg

SEQ ID NO: 265337 - DNA, 664 bp, Homo sapiens
  misc_feature: GYAE6OF01BAE49.34.26.C04.1.454.CMB.1.raw
  modified_base (247)..(247): a, c, t, g, unknown or other
  misc_feature (247)..(247): n is a, c, g, or t
  modified_base (369)..(369): a, c, t, g, unknown or other
  misc_feature (369)..(369): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggccccagccgtgggaccgtcccngacgactctcctgtcgcagcgtctggacttcgaccttcagtagtcagtggcatgcacgtgggtcccgccaggcctaccgaggcaaggggctgggagtggggtgccgtagttactagtggtangagtaggaagttagtctaaataacgtatcggactagtaccgtcggtaggaacgggtcccgtattacccgtacccgtacgtcccgaaagaacgaaccgtaaactacccgaaacgaaccgaccgtcgttacgtacttccgtagaaccttaaacgcgtaacccgtaacgtaccgtagtaccggaacggtacccggaacgggacccgaaaccggggttacctaacggttacgttaaacgtttacggttacggttcggacggtacggaaagggacggaaactaccggcccctaaaccggg

SEQ ID NO: 265338 - DNA, 749 bp, Homo sapiens
  misc_feature: GYAE6OF01BUYQB.34.26.C04.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (738)..(738): a, c, t, g, unknown or other
  misc_feature (738)..(738): n is a, c, g, or t
tcagtacacgtgatcacgaccggtgctcgatttagtctagcgactttggggtttggggctgggagaggagcccagcactagaggtcggcggtgtttccattcggtgatcagcacgtgaaccacgaggaggtactcaccgagtgggtaggtttgggctggcggttcgttttcggggtttttccctggtttacgtactttacgtttttaaaggngggttcgtaccgtaggttggttacgaggggtcncgtaggtcggttggggtagggtacggttcggggtggggggacggtccgtaccgggcccagggtccggtcgggaccctccgagacctccttcgtctggcacgtcgtcgttcgtacgtctacctagtacgtagtcgagngtcgactacgtcggaccgttcggcccgtccgacggngtacccggngacggggaggtacggtggtgggtggtaggttcgatttaagtgtaggtagtagacggtagtacggtataatacgatactgacgacggtgtaaccggtaggacggtcgtcgtactaccgtacgtacgacgtaacgaaccgaacctaacgtaaccgaagtacgtacttacgtagttacccgaggtaaaccttaacgaccggtaacgaaccgtcggtaaccgacggaccggtacggaccggtacgggtactaggttacgttaagttacgtaggttacggcgaaacgtgggacgtaacggcccgtaagtaaccggnggttaacccgg

SEQ ID NO: 265339 - DNA, 639 bp, Homo sapiens
  misc_feature: GYAE6OF01BN8ZF.34.26.C04.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (472)..(472): a, c, t, g, unknown or other
  misc_feature (472)..(472): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttggtttcctcgttgctctttaagnggtntccagtgtcaggtnccgagcgtggtggagtcggnggggagcgtcggccagccgtgggacctccgtgagctctaccgtgtagccgagtccgtagtggtactttccacctttgagttaggtccaagtcggcagtcgacngtcggccnccgagctaccggagtacgtagggntacgggnggtacggngactaggtatgaggtangagtcggtaattcgataacgttacagtccgagtacggacttcggaggtacggcctactacgtcctcgtacagaactacgacaaccgaacganaccgagtcgtacctagtacgtaactaagtaccgactaccgtaccgagaaccggcggaaaccggtaacgtaccggtaaacggtccgttaaggttacttacggttaacccgtagggttaacgccgggaaacggttacggaaacgtaacgggacgttaaacccccggtgg

SEQ ID NO: 265340 - DNA, 793 bp, Homo sapiens
  misc_feature: GYAE6OF01ET1VX.34.26.C04.1.454.CMB.1.raw
  modified_base (198)..(198): a, c, t, g, unknown or other
  misc_feature (198)..(198): n is a, c, g, or t
  modified_base (631)..(631): a, c, t, g, unknown or other
  misc_feature (631)..(631): n is a, c, g, or t
  modified_base (783)..(783): a, c, t, g, unknown or other
  misc_feature (783)..(783): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcggtaggtnacgcgtggtggtggtacggtggggtagggggcggtcggtcccggaccgtccgtcgggtacgggtacccgttccggtacggacgtccttccctcgttcggcacggcgttcgtcggtacgtacttacccttaccgtacgtaaggttactacgtagtcgacttagtcgaccgtcgggttcccggcccggtacggtaccggtcccgaccgggacgggtaaacggggtcggtacggggttacgggtcggggttaggggtcggtaacgttaagttaggtaggtttaggtacggtagtagggtaacggttaaacggtagtaaacttaataccgtagtcggacgtaccgttacccggtaggtaacgggtaaccggtccgttacgtacccgtacccgttaccgaataacgggaaccaaccgtaccccaagaaaccggtaccncgtagtaccgttacacggtacaacggtaacgccggtaacgtccgtaacgtaacggaaccgggaaccggtacggaaacccggtcgtaaacggttataccggtttagtaaaccttggtcgggacgaacgggtagtaacgaccgaccggtaccgngttaaccggg

SEQ ID NO: 265341 - DNA, 657 bp, Homo sapiens
  misc_feature: GYAE6OF01ELRTI.34.26.C04.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (402)..(402): a, c, t, g, unknown or other
  misc_feature (402)..(402): n is a, c, g, or t
  modified_base (521)..(521): a, c, t, g, unknown or other
  misc_feature (521)..(521): n is a, c, g, or t
tcagtacacgtgatcacgaccggtgctcgatttagtctagcgactttgggtttggggctgggagaggagcccagcactagaggtcggcggtgtttccattcggtgatcagcactgaaacacagaggactcaccatggagtttgggctggagtcgttgggttttcctcgtttgcttcttttaaggaggtgtccagtgtcgaggtncagcgtgggtggagtcggngggggagcgtggcccagccgtgggacctccngacgactctccgtgtgcgngtcgtctaggacttctaccttcgaggttatcaagtggctagngcgacggtcgggtacccgccgacggtcctaccgagggacggaaggggtctaggggaggtggggtacgagttagttagtagtggttanggtaacggtaggaaacgtacgtaactaaacgtataggtcaacgtacgacgttacggaggtaaccggctacttaccgaccgttcaacgagaaacctaacgaactacccgaaacgaaccgngtacttagtacgtactaccgaacgaaacttcgaacctagtaccgtaagaccgaacggtaccggacggacctaacggtcgtaagttacgttattacgtcgggtaagacggtaggaacgacgacgaccgacgtaccgg

SEQ ID NO: 265342 - DNA, 789 bp, Homo sapiens
  misc_feature: GYAE6OF01B36EK.34.26.C04.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtncagcgtggtggagtcgtgggggagcgtggcccagccgtgggactccctgacgctctcctgtgcagcgtctggattccaccttcagtagtcagtggacatgcacgtcgggtcccnccaggcctaccgagggacgaaggggtcctaggggaggtcggggtaggtctaagtttagtagtagggtataggagttagggaaagttacgtacctaaaagttacctagtcggacctaagggtacccgttaccggaacgggtaacggggtacccgtaacgtttacccggtaccccggttaccgtaaccgtaaggtaaccgtaacccgtaaaacccgttaacccccggaaaaacggtaaacccaacccggggttacttaacgggttttaaacctacccgttaacggtaaaaccgttaaaaccgtacccgggtaaaccccggaacggttacccgtaacggggaacggtaacccggaacccggggtaaaccggaacccgtaacccgggtacgttaacgtttagggttaaaccgtttacggtcgggtaacggaaccggaaggaaccggtaaacgaacccggtaaccggaaccccttaacccggg

SEQ ID NO: 265343 - DNA, 945 bp, Homo sapiens
  misc_feature: GYAE6OF01DF4BJ.34.26.C04.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcacatggagtttgggctgagtctgggttttcctcgttgcttcttttaagaggtntccagtgtcaggtncagctggtgagtcggtgggggagcgtcggcccgaggtccgtggggacctccctaggacgtaccttccgtccgtggtcgccgaggtccgtcgtggtacttccgtaacccctttgtaaggttaacgttccgaagtttcgggacctaagtttcggacccgtaacccggtttcgggggttcccccgacccgtaacggggtacccgtaccccggtaaacgggggaccgggtaaaaacggggggtcccgttaggggggtaagggtttcggggggttcgggaacgttaaggttttaacgttagggtttaagggtttaaactaggggttaaaggtttaaggggttaaaacggttaacgttaacctaaagtttaaccgtagtttaaccggacggtaaccggtaacccggttcccgggttaacgggtaaaccggggtacccttaacgtttacccggtaaccccgttaccggtaacccgtaaacgggaaaccgtaaacccgaaccgttaaaacccccgtaaaaccggtaaaccgtaacccggttacgttaacggttaaccgttccgttaaaccggtaaccttaaaaaccgttaaccgggaacccgtaaccgggttaacccgtaacgggtaaccggaaccgggtacccgggaaagggtaaccccggtaacgggttacttaacggttacggtttaacgttacggttagggtaacggtacggaaggtaacggaaccgtaacgggaacctcccggtaaaccgg

SEQ ID NO: 265344 - DNA, 823 bp, Homo sapiens
  misc_feature: GYAE6OF01AOZ0L.34.26.C04.1.454.CMB.1.raw
  modified_base (291)..(291): a, c, t, g, unknown or other
  misc_feature (291)..(291): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggaggtttgggctggagtcgttggggttttttcctcgtttgtccttcgtttttaaaggaggttgtcccaggttgtcagggtgcaggcgtgggtggaggtcggtggggggaggcggtcggcccaggccgtgggccgtccctggacgtcctctccgtgncgcgtcttgtgtaccttcctaccgttcgtaagtactcgagtcggctagtcggtaccgtaccggttccggggtaccccgccggtaccggtccgtaacccgggagggacgggtaacgggggtcggtagggggtcgggttgggggtacggttacgttaaggtttaagttagggttagggttaggtaggttaagggtaacgggtaagtttaacggttaaacttaaacgttacgttagaacggtacccgtaaacgggttacccggttacgggtaacggggtaacccgggtacgtttaaccccggttccccgttaacccccggttacaaacccggtaaaggaacccctaaacccgtaaacctaaccccggaaacgtaacccgtaccggttacttacgttaaccgtacgtaacgaaaccttaccggaccgaaccgacgtcggaacggtacgaccgggacgaaccggacgaccggttattacgttacgttacgttcggacgtaggaccggaagtaacggacaccgtacgtaccgtacggg

SEQ ID NO: 265345 - DNA, 783 bp, Homo sapiens
  misc_feature: GYAE6OF01E3FL2.34.26.C04.1.454.CMB.1.raw
  modified_base (180)..(180): a, c, t, g, unknown or other
  misc_feature (180)..(180): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggtagttggctgagcgttggtttcctcgttgacttacgttttaaagnggtcgtccagtgtcaggtgcaggtcgtggtaggacgttcggtgggggtacgccgtcggccccgaggtcccgtgggacccttcccgtagacgtaccttccgtccgttaggtcgccgacgtacgttaccgtggtaacctttacccgtaacgttttacgaagttacggtcctaggtacggctaacgttccggtaccgtaaccgggttacccgggtccccgaccgtaaccgggtcccgtaaccggaacgggtaccgggtaaaggggtcccggttaaggggtacggggttacgggtaggtacccgtttaagttaacggttaggtagggtataggaagttacggtaaagttacgtactaaacgtttcgaacgtagacgtaccgttaaccggtacggtaacgggaccggtacgtaacgttacccgtaccgttaccgtacgaagtaacccgtaacgaacctaacccgaacgtaaccgtacgtactacgttacgtacgtaacgtaacgaacgttaccgaaccgtagtaccgtaggaccgacggtaccgaacgaccgtacgtatacgtaagttacgtgtacggagcggtaagacgaacgtcacgtacgtacgg

SEQ ID NO: 265346 - DNA, 798 bp, Homo sapiens
  misc_feature: GYAE6OF01AL6AK.34.26.C04.1.454.CMB.1.raw
  modified_base (249)..(249): a, c, t, g, unknown or other
  misc_feature (249)..(249): n is a, c, g, or t
tcagtacacgtgatcacgaccggtgctcgatttagtctagcgactttgggtttgggctgggagaggagcccagcactagagttcggcggtgtttccattcggtgatcagcactgaacacagaggactcaccagtggtagtttggctgagtcgttggttttcctgttgtcttacttttaagaggttgtccgagtgtcgtaggtgcaggtcgtgggtggtaggtcggtagggggagtccggtccggacccncggtcccggtcgggtaccgtcccgtaggacgttcccgttcctccgtagtcgcgtacggtccgttcgtaggttaccttaccgtaccgttcgtagttacgtccgtaggttcggcttacgtccggtaccggtaccgggttccgggtacccgacccggaccggtacccgtaccggaccgggtaaccggggaggggttcggtacgggtggggttacgggttcggtaacgtttaggtttaacgttaggttaggtagtagtaaggtaaggtaagttaacgtactaagttacgtaggtacctacggtacgtaccgtacggtaacggacggtacgtacgttacccgacccgtacgaaccgagaccgaaccgtaccgaacgaaacgtacgtccggtaacttacggacttacgaacgtaacgtacgtacccgtaccgtaccgtcgtaaccgggcgaaccggaccgggtaccgtaaaccggttccgtaagttcgttaacggtagttaccgtacgggtaggtaacgtaacggtaacggaccgaacgtcccgaacggtacggg

SEQ ID NO: 265347 - DNA, 765 bp, Homo sapiens
  misc_feature: GYAE6OF01AB86M.34.26.C04.1.454.CMB.1.raw
  modified_base (186)..(186): a, c, t, g, unknown or other
  misc_feature (186)..(186): n is a, c, g, or t
  modified_base (465)..(465): a, c, t, g, unknown or other
  misc_feature (465)..(465): n is a, c, g, or t
  modified_base (635)..(635): a, c, t, g, unknown or other
  misc_feature (635)..(635): n is a, c, g, or t
tcagtacacgtgatcacgaccggtgctcgatttagtctagcgactttgggtttggggctgggagaggagcccagcactagaggtcggcggtgtttccattcggtgatcagcactgaacacgagaggactcaccagtggtagtttgggctgagtcgttgggttttcttcgttgcttacgttttaagnggttctccagtgtcgaggtgcgagcgtggtgacggttcggtgggggacgtcgtccggcccgaggtcccgtagggtaccgtcccgtaggaacgtccgttcctccgttaggtcgccgtaggtccgttcggtacggtactttacccgtaccgttgacggttctacgtagttcggactacgtcgacgtaccgggttcggccctaccggaggccctaccggagggtacggaacggggtctaggggtaggtcggttacgactttaggttaatcggtaggtaacgnggttaagtagggttaaactcgtaaagtaaccctttagtacggtacgaaccgtaccggtacggttacggtaacgggtacccggttaacgtcttacccggaccccgttacgacccaaagggtaaccaacccgttaaccgaacgaacggtaccgtcgttaagtcctaaccgtntaccgaaacgtacggtacgaacccgttagaccggaagtccgaacgggacgtaacgtccggaacttaggtccttaacggttatacggggtacaggttaacgaagaccggtacgacgtaccgtcccggtagg

SEQ ID NO: 265348 - DNA, 772 bp, Homo sapiens
  misc_feature: GYAE6OF01CHZY1.34.26.C04.1.454.CMB.1.raw
  modified_base (251)..(251): a, c, t, g, unknown or other
  misc_feature (251)..(251): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttccttgttgcttacttttaagaggtgtccagtgtcaggtgcagcgtggtggagtcgtgggggagtcgtggcccagccgtggggaccttcccnggacaccttctcctgtcgctaggtccgtcgtggtacttccctacccgtttcgaaggttacgtacgtagttcggacctagtcggaccgtaccggttcgggggtccccaccgtacggggtcctacccggaacggggtaccggaaacggggggtcctagggggtaacgggttcggggtacgtacgtttaaggtttatagttaggggtataaggtaggttagggtaaacggttaagtctaaaacgttacctaggttacggaacgtacgttaacccggtaccggttaagggtaacccgggtcccttaagttccccgtacggttacccacgtaacggaaccgtaaccgaaacccgtaacccaacgtaacccgtacgtaccttaaggttaacctccgtaataaccggtaaacgtcccggtaaccgaccgtaccgaaggtacgaccggaaccggtacggaaccctacggtagttaacttggttacttaccggtggaccgacgtaaggcgaaccgacgtccgtactacgg

SEQ ID NO: 265349 - DNA, 707 bp, Homo sapiens
  misc_feature: GYAE6OF01DVTSU.34.26.C04.1.454.CMB.1.raw
  modified_base (314)..(314): a, c, t, g, unknown or other
  misc_feature (314)..(314): n is a, c, g, or t
tcagtacacgtgatcacgaccggtgctcgatttagtctagcgactttgggtttggggctgggagaggagcccagcttactagaggtcggcggtgtttccattcggtgatcagcaactgaacacagagactcaccatggagtttgggctagagcttgggttttcctcgttgccttagttttaagaggtgtaccagtgtcaggtgcagtctggtggagtcgtgggggagcggtcggcccgaggccgtacgggaccgtccccgtaggacgtacctccgtccgtggtcgcaggtccgtcgtggtaacttcctaccttntaaggtacgtctagtggacctatcgcgtacggttccgggcccgaccgtagcccgtaccggagggaccggtaaggggtccggtaggggtaggtcggggtgacgttaaggttagtagtacgtagtagtagtaacggtaacgtgttaacaagtttacgtagtacgacgtaacggtccgttaccggtacgggaaccggtacctattcccgacccgttcaacgacgtacgaacccgtaactaccccgaaagtaccgtactccgttataccgtcttaaggaacctaacgaccgtacaccgtccggtagaccggacggacccgaacggaccgtacgtgttaacttagtacttcggacgaccgggaacgtaaggaactcgaaaccgtcgtaccgtaaccgg

SEQ ID NO: 265350 - DNA, 749 bp, Homo sapiens
  misc_feature: GYAE6OF01C83C2.34.26.C04.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcacatggagtttggctgagcttgggttttcctcgttgcttcttttaaggaggtgtccagtgtcaggtgcagcgtggtggagtcgnggggagcgtggcccngccgtgggacctccctgacgctctcctgtcncgagtcgtcgtggtactctaccttgtacgtagtccagttcggctagtcgaccgtacgtcggggtcccgccgtaacggcccgttaccggagggtacggaaacggggtcgtagggacggttggggtcgacgttaaaggtttacttaggtcggttaagtacggtagttaagggaacggtttaacgtaacgtaaattacgtaaggttcgaaccgtaacggttaccgttaccgggtagggaaaccgggtaccgtacgttacccggtacccgttccgtaaccggaaaggtacccgtaacgtaaacccttaaccccggaaaagtaacccggtacgttaccgtgttaaccgtcgtaacgaccgtaaacgtaccgaacgacccgttacgtacggacgtaccggacccggtaaacgtaccgaacggttcgttaaacgtcggtttaaccttaagtcgggtaacgacggttaaggaacgaaccgtacggacgtcccggtaacg

SEQ ID NO: 265351 - DNA, 817 bp, Homo sapiens
  misc_feature: GYAE6OF01AJI53.34.26.C04.1.454.CMB.1.raw
  modified_base (166)..(166): a, c, t, g, unknown or other
  misc_feature (166)..(166): n is a, c, g, or t
  modified_base (204)..(204): a, c, t, g, unknown or other
  misc_feature (204)..(204): n is a, c, g, or t
  modified_base (802)..(802): a, c, t, g, unknown or other
  misc_feature (802)..(802): n is a, c, g, or t
tcagtacacgtgatcacgaccggtgctcgatttagtctagcgactttgggtttgggctgggagaggagcccagcactagaggtcggcggtgtttccattcggtgatcagcactgaacacagagactcaccatggtagtttgggctgagcgttgggttttcctgttncttcttttaaggaggtctaccgtaggtcgtcgtaggtncgagtcggttagggtaggtcggtcgggtagggggacggtcggtccggacccgtaacggtccgggttacgggtacccgttcccgaggtacgtcctccgttccgtggtccgccgtacggtcccggttacccggactttttacccacccggttagtaacggttaccgtcgtaacggtacgccgttacgtacggtcccgtacggggtttccccggccccggcccggtaagtcccggttccggaaacgggggtcgggaaggggtccggtaggggttaccgggtggggtaccgtaacggttagtttagtaaacggttggtacgtaggtaaaggtcgggtaaggtactaaggtaaactcggtaaaccgtgaacccgtagtcccggtttaggaacggtaccggtaccgttaccttaaccgccgttaccgtaaccgtaagaaccgtaaaccgtaacgtacccgaaaacgtaccgtacccgtagttaaccgtaggtaccttaagaacgtaacccgtacgtaactacggtcgtagaaccggaggtacccgaaagtccgtacgtagtattacgtacttaggcttacgggaaataggtacgaccgttaacncggtcgtcgtacggg

SEQ ID NO: 265352 - DNA, 802 bp, Homo sapiens
  misc_feature: GYAE6OF01ARIXY.34.26.C04.1.454.CMB.1.raw
  modified_base (732)..(732): a, c, t, g, unknown or other
  misc_feature (732)..(732): n is a, c, g, or t
  modified_base (761)..(761): a, c, t, g, unknown or other
  misc_feature (761)..(761): n is a, c, g, or t
  modified_base (769)..(769): a, c, t, g, unknown or other
  misc_feature (769)..(769): n is a, c, g, or t
  modified_base (774)..(774): a, c, t, g, unknown or other
  misc_feature (774)..(774): n is a, c, g, or t
tcagtacacgtgatcacgaccggtgctcgatttagtctagcgactttgggtttggggctgggagaggagcccagcactagaggtcggcggtgtttccattcggtgatcagcactgaaccacagaggactccaccagtgggtagtttgggctggacgtcgtttcgggtttttccctcggtttcgtacctttacgtttttaaaggaggttcgtacccgtaaggttgttaccgtaagggttgaccgtaggtccgttggggttcggtaggtcgggtgggggggaggtccggtccggacccgtacggtcccggttacgggtacccgttcccgtggaaccgtccttccgtccgtggtcgcgtacggtcgttcgtggtacttccgtaacccttacgtagttacgtacgtagtcggactacgttcgcgtaccggtccgggtcccgcggtacggccgtaccggacgggtacggtaacggggtcgtagggtacgggttgggtacggtactttaaggttagttaaggttgggttaagtagggtaacgtttaagggtaacgttaacggtaacttaaagttacgtaggttacgaacggtaccggttacgtaccgggtaaggtacccgggttaccttacggttacccgtccgttaacccgtacgaaacgttaccgaaaccgtaacctacccgaaacgtacccgattccgtatacgtactacgaactacgtaccgactacgtaccgnggtacgacggtaccgagaccgtaacgttntaaacgtntacgngtggcaggtagacgaccagccgtctagg

SEQ ID NO: 265353 - DNA, 774 bp, Homo sapiens
  misc_feature: GYAE6OF01ACYI7.34.26.C04.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgttggtttccngtgcttacttaagngtncagtgtcagtgnagtcgtaggtcgngtcgtgggtgacggtcgtaccggccgngtaccggtcggactcccgtgaacgttccttcgtaccgngcgactaggtaccgtcgtagtacctttcctaaccgttcgtaagtagttaccgaagttcgggactaacggttcggaacccgttcgggttacccggacccggtacgacggtacccgccggaaggggtaccgggtagggttaccggngggacggtttgggaccgtagttaacggtagttagtaggtagtcggtaagtacggtaagttataaacggttacttaggtccgacgtacgaacggtaccgttcggaaccgggtacgtaccgttaccgttacgttaacccgaccttaacgggaacgtaccgtaaacccgtaaacgttaacccgaacttaccggtaacgttaccctttaagaccgttaacgaccgttaaacctaacggaccgtaaacggtccgacggtaacgaacggtaccgggacgtaaccggacgttaccgttaacgtacgtttaacggtacctttggaggaaccggtacgaaccggttagaacccgtagtccggtaaacccggg

SEQ ID NO: 265354 - DNA, 648 bp, Homo sapiens
  misc_feature: GYAE6OF01B1DSX.34.26.C04.1.454.CMB.1.raw
  modified_base (324)..(324): a, c, t, g, unknown or other
  misc_feature (324)..(324): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggcccagccgtgggaccgtccctgacgactctccgtgtgcagcgtcgtggtacttccaccttcagtacgtcagtggcagtcgacctacgtcgggtcccnccgaggcctccgaggcggaaggggtctgggaggtgggtcggctagttatagtggttatgagtagggaagtagtactaaagttactagtgacgtagtaccgtacgggtacggaacgggtaccgtacgttcccgacccgttcctaccgaaggaacgaacctaaccgtacccgaaacgaacccgtacgtacgttagtaactacgtacgaactaaacgtccgaaccgacgtaccgtaggacggaccggaccggacggtaccgtacggtcgttacgtacgttaacttcgtggtacgaacggtagaacgaagaccgtacgcccgtaacgg

SEQ ID NO: 265355 - DNA, 674 bp, Homo sapiens
  misc_feature: GYAE6OF01BDCCV.34.26.C04.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgctcttttaagtaggtgtccagtgtcaggtgcagctggtggagtcgtgggggaggcgtcggcccgagcctcggggtaccgtccctgacgactctccgtgtcgcagcgtcgtggattcaccttacngtagtcanggtcatgccgtagtcgggtccgccgacggctaccgacgggacgaacgggggctgggagtggggtcggactaggtttaagtgtgggtatcgagtggtaagtacgtacgtaattaccgtagtcgacaggtacctcgggtaggaaacggggtccgtacgttccctaacccggtccgttacccgaaggaacgaacctaaacgtaaccccggaaaccgtaaccgaccggtacgttacttacggtacctaacgtacgaaaccgtcggaaccgtacgtacccgtgaaggaacccgcgggaaggtacccgacggtcgtaagttgttaactcggttcggttagaaccgggtaggaaggtaaccacccgtgtaccggtaacccgg

SEQ ID NO: 265356 - DNA, 693 bp, Homo sapiens
  misc_feature: GYAE6OF01A937B.34.26.C04.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctgagcttgggttttcctcgttgcttcttttaagaggtgtccagtgtcaggtgcagcgtggtggaggtcgtggggggagcgtcggcccaggtcccgtggggaccgtccctggacgtcctctcctggtagccaggccgttctaggtactttccaccgtttnaagttagttccagttggacctagtcggcctacggtcgggtcccnccgaggcctaccgagggaccgtaaggggctggggacggtgggnggcttaaggttatagtgggtatggactgggaaagttagtactaaagttactagtcgacgtaacggtaccgtacggtaggtaacgggaccgtacgtttaccgaccgtacctaaccgaacgaacgtaaccgaacctacccgaaaacaacgtaccgtacgttacgtaactcgtaccgaacgtaacgtaccgaaccgtacgtacgacggaacgaccggtaaccggaacggtaccgtaggttaccgtacgttacgttaagttaacgtggtaccggacggaaggtaagaaccgtacgaccgccgtaacg

SEQ ID NO: 265357 - DNA, 824 bp, Homo sapiens
  misc_feature: GYAE6OF01EAT91.34.26.C04.1.454.CMB.1.raw
  modified_base (183)..(183): a, c, t, g, unknown or other
  misc_feature (183)..(183): n is a, c, g, or t
tcagtacacgtgatcacgaccggtgctcgatttagtctagcgacttttgggtttggggctggggagaggagcccagcactagaggtcggcggtgtttccattcggtgatcagcactgaacacagaggactcaccatggagtttgggctgagtcgtttggtttcctgttgtctttagtttaagnggtcgtctagtgtcgaggtgcgagtcgtgggtcggtaggttcggggtggggggacggtcggtccgggacccgacggtcccggtacggggtaccgtcccgtaggaccgtaccttcctcggttggtcgacgcggtccgttcgttacggtacttaccctactttacgaaggttacgtcgagtcggactgtcgaccgtcggggttccgggtccgaccggacggtccgtaaccggagggaccgggtaaggggtcgtaggggtacggggttgggtacgtagttaaggggtttataggtaggttacgagtaggtaggtaaagttacgtaactaacgttacgtacgtagaaccggttaacgtacccggttacgggtaaccgggaaccgggtacctttaccggttaccccgtacccgttacccgaaccgtaacgggaaacaaaccccgtaaaccctaaaacccggaaccgtaacccgtaccgtagtttacgttaactaaccgtagaaacctaaccggtaaccgtaaccgtacggtacccggagggaaccggacccggaccgggtaacgacccgttacgggtaactttagggttagtttacttcggaggttacgaagggtaacgaacgtaaccgactaccggccgtaacgg

SEQ ID NO: 265358 - DNA, 774 bp, Homo sapiens
  misc_feature: GYAE6OF01DOPOY.34.26.C04.1.454.CMB.1.raw
  modified_base (180)..(180): a, c, t, g, unknown or other
  misc_feature (180)..(180): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcttgggttttcctcgttgcttcttttaagnggtgtccagtgtcaggtgcagcgtggtggagtcgtaggggggagtcgtggccccaggcctgggaccgtccctgagtacctctccgtggtcgcagtccgtcgtaggtacttccgtaaccttacgaaggttacgtcgtaacgttgggacctaggtacgccgtaaccggttcgggggtccccgacccgtaacgggtcccttacccggaggggtaacccggaaggggggttccgtggggtaacggggttgggggtacggtacgttaaggttttaagttaggttggggtttaaatggggtaaacggttaaggggtaaaacgttacgttaacgtaaactttactaagttccgaacgtaaccggtacgtacccgggtaaggaacgggtacccgtacgtaccgtacccgttacaccgaaggtaacgaacgtaacctaacccgaaacgaccgtaacggtacgttagtaccgttacgtacgtaaacgtaacgtcggaaccgacggtaccgtaaggacggtaaccggaaccggacggaaaccgtccggtacgtaacgttaggtacgttacggtggtacggacgtaaggagagacacgccgtaacg

SEQ ID NO: 265359 - DNA, 731 bp, Homo sapiens
  misc_feature: GYAE6OF01C0LEJ.34.26.C04.1.454.CMB.1.raw
  modified_base (178)..(178): a, c, t, g, unknown or other
  misc_feature (178)..(178): n is a, c, g, or t
  modified_base (719)..(719): a, c, t, g, unknown or other
  misc_feature (719)..(719): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagctgggttttcctcgttgcttcttttaaagnggttgtccagtgtacaggtgcagctgggtgaggtcgtgggggagcgtcggcccaggtccgtggggaccttcccgtagacgtacctctctggtgcaggtcgttctggtactttccacctttgtaagtacgtacagttggacctaagtcgaccgtacgttcggggtccccacgtacggccttaccggagggtacgaagggggtccgttggggacgggttggggtcgaacgttaaggtttagtaaggtagggttaataccgggtaagttaacggggtaaacgttaacgtactaaacgtttaaccgagtagtccgtaaacgggtccgttaccgggtaagggaaccgggtccttaacgttcccgaaccccggttctaccgaaagtaaccgaacctaaccgtacccaaaggaccacgtacgtacgtaacgttctacgaaacctaagtaccgaacacgttacccgaggtacggaaccgtacccggaaagggtaccgtaccggtaagttacgtactttacgttacgcggtcgaacgtaaggacgacacncggaactaccgg

SEQ ID NO: 265360 - DNA, 771 bp, Homo sapiens
  misc_feature: GYAE6OF01D7PW1.34.26.C04.1.454.CMB.1.raw
  modified_base (659)..(659): a, c, t, g, unknown or other
  misc_feature (659)..(659): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttcggctgagcttgggtttttcctcgttgacttcttttaaaggaggtcgtccagtgtcgaggtgacagcgtggtggagtacggtgggggacgcgtcggcccaggccgttaggggaccgtccctgagtaccttcgtccgtggtcgccgtaggtccgtcgttacgggacttttaccgaaccctttgacggttaacgtcgtaagtggccaagttgaccgtacggtcggggtcccaccgtaggcctaccgagggaccgtaagggggtcctaggggtacggttgggtacgggaccgttaaggtttaactaggtacgggtaaatggtaaagttcggggaaaagttacgtacgtaaaacgtttactaaagtcgtacgtaagtacccgtcggtaacgggaaacgggtccgtaacgtttcccgaaccggttctaacccgtaagaaccgtaaacgtaactaaccccgaaacgaaaccgaccgtacgtacggtaacttccgtaacggtaaccaaacgtaccggtaacccncggtaaccgtacggaacgacggacggaaccggaccgaaccggtactagtacgttacgttccgtacggtacggaacggtaacgacggtaaacggtccgaaccgcccgtaacgg

SEQ ID NO: 265361 - DNA, 884 bp, Homo sapiens
  misc_feature: GYAE6OF01D4DDU.34.26.C04.1.454.CMB.1.raw
  modified_base (159)..(159): a, c, t, g, unknown or other
  misc_feature (159)..(159): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
tcagtacacgtgatcacgaccggtgctcgatttagtctagcgactttgggttggggctgggagaggagcccagcactagaggtcggcggtgttccattcggtgatcagcactgaacacagaggactcaccatggagtttgggctgagctgggttttccncgttgcttntttaagnggtgtccagtgtcaggtgcagcgtggtggagtcggtaggggggcgcgtggcccaggcccgtgggaccgttccctagacgaccttcctacctggngaccgagtcggttctacggaactttcctaccctttcgaaggttaagtccaggtcggacncgttcggtaccgaccgggttcggggtccccgaccggaggtaccccgtaccgagggggtaccggtaaacggggggtcctaaggggggtggttaggggggacgtaccgtaaaggtttatagggttacgggttaagtgggaatttaacggggggtaaactttacggaaacggtaaaaactttccggtttaaggtcgtaaacccggtaaagggttacccggttaccgggtaaaggggtacccgggtaacccgttacgttaccggtacccgttacctaaccgtaaacggaaccgtaacctaaccggtaccccgtaaaacgaaaccgtaccggttacgtaacggtttaactaccggaactaaaccggtaaaccgtaccgggtaaaccccggttaacgtaccccggggttaggaaccgggtaacgggaaccccgggtaaacgggtacccggtaaccgggttaccgttaaagtttacggggtttaacgttacggtacgggttaaggaacccggtaaaggtaaacggggaaaccgtaccgggaaccgttaccccggtaaaccggg

SEQ ID NO: 265362 - DNA, 861 bp, Homo sapiens
  misc_feature: GYAE6OF01D5JL2.34.26.C04.1.454.CMB.1.raw
  modified_base (201)..(201): a, c, t, g, unknown or other
  misc_feature (201)..(201): n is a, c, g, or t
tcagtacacgtgatcacgaccggtgctcgatttagtctagcgactttgggtttggggctgggagaggagcccagcactagaggtcggcggtgtttccattcggtgatcagcactagaaccacgagaggacctcaccagtgggtagtttgggctgaggtccgtttcggggtttttcctcggtttgtctttacgttttaaggnggttctaccgtaggtgtcgaggtcgctaggcgtggtggaggtcgggtagggggcgcggtcggcccgaggtccggtgggtccctccgtagaccgtacctccgtccgtgctcgacggtctcgtgtaccttcctaccgttagagttacgtcgtagtggctaggtcgaccgtacgggtccgggcccgaccgtaggtcccaccgggacgggtacgggaacggggtcgttaggggtacggttggggtactaacgtttagtttaaggttagttagggtaatagggttacggtaagggttaaacttacgtaacgtaaagtttccggtagtcccggacgtaaacggttcccggtaaccgggtacggtaaacccggggttaccttaccggttaccccgtaacccggttaccaaccgggttaacgaaaccgtaacccgtaaacccgttaaccccggaaacgtaacccgttacgttacgttaacgttaaccgtaaccgttaaccgtaaacgaacccgtaaccggtaccgaacccgtacggtaacgggtaccggaaccggacggaaaccggtcccgtaagggttaccttaacggttacttaacggttacggtacggtaccggaaacggtaacggaacggaacccggtacgaaccccggtaacgttacccgggg

SEQ ID NO: 265363 - DNA, 718 bp, Homo sapiens
  misc_feature: GYAE6OF01CJTCJ.34.26.C04.1.454.CMB.1.raw
  modified_base (180)..(180): a, c, t, g, unknown or other
  misc_feature (180)..(180): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagtcttgggttttcctgttgcttacttttaaagnggttgtccagtgtcaggtgcagcgtgggtggagtcgtggggggagcgtcggacccagccgtgggacctcctagacgtaccttctccgtggtgacaggtccgttacgtggtactttccaaccgtttgaaggttacgtcagtggacctagtcgacctacggtcgggtcccacgtaacggcctaccggaggcgaaggggtctagggaggtgggggtacgacttaaggttatagtggtataggagtaggtaagtagtacaatacgtagtcgactaacggtccgtacggtaggaacggtcctaagttaccgaccggttctaacccgaaggaaccgtaacaaaccgtacccgaaaagtaccgaccgttacgtaagttaccgtactaggaaacctaaacggtccgaaaccgtcggtaaccgtaagggaacggtaacggaaccgggtaacgaaccggtaaccgggtactttaaacggttggttaaactttaccggtgggtaacgtaacgggaagtaacgggaacgttaccgacgttacccggaacg

SEQ ID NO: 265364 - DNA, 650 bp, Homo sapiens
  misc_feature: GYAE6OF01CYWM0.34.26.C04.1.454.CMB.1.raw
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (525)..(525): a, c, t, g, unknown or other
  misc_feature (525)..(525): n is a, c, g, or t
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggagtttgggctgagtcttgggttttcctcgttgctcttttaagaggtgtccagtgtcagtncagctggtggagtcgtgggggagcgtggcccaggccgtggggactcccgtgacgtactcctctggtncgagtcgtcgtggtacttctaaccttnagtacgttcaagtcggacagtcgaccgacgtcggggtaccccncgtacgggtaccctccggaagggccggaaaggggtctaagggcggtggggtacgcgttaagttagtagtggttaanggtacgtaaggtaaacggtctaanagttaaatcgtagaccgagttaccgtacgtaacgggacggtaccgtaactaccgtacccggtctaacgacggaactacgaactaacccgaanaccgtagacctataacgtcaacgaactaacgtcgaacctcgactaggactacggaccgagaccacggttactaagtccgttataacgtcggactaaggacgtaaacgngaaccncgtcccaaacg

SEQ ID NO: 265365 - DNA, 670 bp, Homo sapiens
  misc_feature: GYAE6OF01CSMI4.34.26.C04.1.454.CMB.1.raw
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (616)..(616): a, c, t, g, unknown or other
  misc_feature (616)..(616): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttggctgagcgttggttctcgtgctagttaagngtntcagtgtcgagtgcagcgtggngagtcggaggggngcgtcgaccgagccgtgggacctccgagtacgacttcgtccgtagtcgacncgtcgtcgtacggtactccgacttgaaagttcgacgtagtggatcgcggaccgacgtcgggtccacgcgcccaggaccggagacgggtgtgggaggtggaggctaagtagtacgaagtcgtagtaggtaagtaaccgggtnaacgtaaagtcgtacgngaacgagttaaccgtccggaagtaccgggtacctacgttaccgaaccgtaccgacgaaacggaccctaacgaaacctaacgaaaccgaacgtacgaacgttacgaagttcaacgtaaacgtacgacgtaacgtacgtacgaaccgaggaaccgggttccgacggaacccgtaacgtggttaaacttcgggttaaacncgggttccgaaaggaagtacggggaacaagtttaccgccggttaaccacccggg

SEQ ID NO: 265366 - DNA, 776 bp, Homo sapiens
  misc_feature: GYAE6OF01A33IA.34.26.C04.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (615)..(615): a, c, t, g, unknown or other
  misc_feature (615)..(615): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggacctcaccatggagtttgggctgagcttgggttttcctcgttgcttcttttaagaggtgtccagtgtcgaggtncgagngtggtggagtcgtgggggagcgtcggcccaggccgtcggggaccgtccctggacgtaccttccgtccgtggtcgccgtacggtccgttcgtaggtacttaccctacccttagtaacgttacggactaagttcgggctacgtcgccggtaacggtccggggtaccccnccgtaacggccgtaccggagggtaccggaaacggggtccgtagggtaggggttcgggtacggtacgttaaggtttacgttgtagggttaagttggaacgttaagggaaagttaacgtaataaacttcgttaagactaccggaagttccggtaccggtaacgggtaacggtccctacgtaaccgtccccgttacaccgaaagtaaccgaaccctaaccgtaaacccgaaggtaacccgtaaccgtnttacgttaatcgtaacgaacttaacgaccgtacgtaccgtaccgtagggaaccaccgggtaccggaacggtaccggacccttacggtaacggtttacttaggtaccgttccgggaggtaaccgtaagggaacgtaacgacggtaaccgaacggttaaccgg

SEQ ID NO: 265367 - DNA, 739 bp, Homo sapiens
  misc_feature: GYAE6OF01CPO46.34.26.C04.1.454.CMB.1.raw
  modified_base (611)..(611): a, c, t, g, unknown or other
  misc_feature (611)..(611): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcgttgcttcttttaagaggtgtccaggtgtcaggtgcaggcgtgggtcgggaggtcggtgggggggtacggccggtcggccccgtacggccgtacgggggtacccgtcccgtaggacgtacctccgtccgttcggcggtccgacggtcggttccgttgggttaacctttcctaaccgtttcgtaaggttacgtctaggtcggctatcggacgtaccggttcgggtccccgacgacggtcctccggaagggacggtaaacgggggtcggtagggtaggggtcggggtaggtacttaggtttagttaacggtcggttaagtaggaagtagggttaaacgtacgtacctaaagttacgtagtcgtacgtagtaccggtcggtaacgggacggtacgttactccgtaccgtacctacgaacgacgaaccgtacaaccgaaacgacctacggtntacgtacacgtagactaaggtcgacgtacgcgtgaacggacggaccgggaacgtacgacggtagttacgtgtttaaccggtgttacgggaccggtgaaaccggtagaacgtaccgcgtacccggacgg

SEQ ID NO: 265368 - DNA, 660 bp, Homo sapiens
  misc_feature: GYAE6OF01ATJ1F.34.26.C04.1.454.CMB.1.raw
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgctcttttaagagttgtccagtgtcaggtgcagctggtggagtcgtgggggagcgtggcccagcctgggacctccctgagactcctcctgtncagcgtctggattccacctttcgagtagtcagtggctagtgccgtacgtgggtcccncgacggtcctaccgaggccgtaagggggtctaggggacggtgggggtagcgtagttaagttagtagggtatggaagtagggtaagttaggtactaaatactagtacgactagtaccgtcggtaggtacgggtccgtagttccacccgttctaccgagaacgaccaaaccgtacccaaagtaacccgaccgtcgttacgtacgtacctagtaacctaaacgttaccgaacccgacgtacccgtagaacgaccggacccggaaggaccgtaacccggtagttacgttacggttattacgtaccggttagaccggtaagtacggaacgaccgtaacgtacccgtaaccgg

SEQ ID NO: 265369 - DNA, 800 bp, Homo sapiens
  misc_feature: GYAE6OF01BP88V.34.26.C04.1.454.CMB.1.raw
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (459)..(459): a, c, t, g, unknown or other
  misc_feature (459)..(459): n is a, c, g, or t
  modified_base (786)..(786): a, c, t, g, unknown or other
  misc_feature (786)..(786): n is a, c, g, or t
tcagtacacgtgatcacgaccggtgctcgatttagtctagcgactttgggtttggggctgggagaggagcccagcactagaggtcggcggtgtttccattcggtgatcacgcactgaacacagacggactcacagtggagtttggctgagtcgttgggttttcctcgttgcttcgttttaagnggttcgtaccagttgtcgaggtncagcgtggtggacggtcgtggggggacgtccgtcggaccccaggtcccgtggggaccctcccgtaggacgtaccttcccgtcgttaggtcgcctaggtccgttcgtacggtacttcctaccgtttcgaagttacgttccgattcggacctagtaccgctacggtcgggcccacgtacggcctaccggagggtcgaacgggggtctaggggtaaggtcggggttcgacttaaggtttaatagggtacggttaanacggtaagtagggttaaaactcggtactaaaaacgttcgtaacgtacggtacccgtaaacggtacccgttcgggaacggtaccgggtaccttaccgttacccggacccgttaccgtaaccgaaggtaaacccgtaacctaaaacgttaccccgaaaacgtaacccgggtactacctttacggtaaccgtacgttaacgaaccgtaaacgttacccggaaccgttacgccggtaagaccggtaaccggccgggtaaagtacccgtacggttaacgttacgttacgttaacgttcggtacgtaacggacgtaacgagtacccggaaccncggtcccttaaggg

SEQ ID NO: 265370 - DNA, 759 bp, Homo sapiens
  misc_feature: GYAE6OF01BTBTL.34.26.C04.1.454.CMB.1.raw
  modified_base (169)..(169): a, c, t, g, unknown or other
  misc_feature (169)..(169): n is a, c, g, or t
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (368)..(368): a, c, t, g, unknown or other
  misc_feature (368)..(368): n is a, c, g, or t
  modified_base (727)..(727): a, c, t, g, unknown or other
  misc_feature (727)..(727): n is a, c, g, or t
  modified_base (743)..(743): a, c, t, g, unknown or other
  misc_feature (743)..(743): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtacgtttgggctggagtcgttgggtttttcccncggttcgtcttacgttttaaaggnggttgtccgagttgtacagggtnccgagtcgtgggtggacgttcgggtgggggagtccgtacggcccaggccgtcgggtacctcccgtaggaaccgtcccttccgtcgtcggtcgaccgtaggtccgttcgtaggtaccttttaccaccgttacgtagtaacgtctaggtccggntacgtacgccggtaaccggttcgggcccaccggtacggtcccgaccgggagggacggtaaccggggtgtagggtacgggtcgggtagtacgttagttacgtggtgtaagtggttacgaggttaatacgtaactaacgttacgtagagaccgaacggtaacggtccggtaacggacgggttaccccgtacgttaaccccgaccgttaccggaaccgaacgtaaaccgtaaccgtaaacccgtaacgaaaccgtaccgtaccgtactcgtaacgttacccaacgtaaacgaacgtaccgaccgtagacccggtagaccggaccggtaacggacgtaccgtacgtattacgtgttacttggngtacgtacgagacganaacgccgtagtaccgg

SEQ ID NO: 265371 - DNA, 829 bp, Homo sapiens
  misc_feature: GYAE6OF01A1W83.34.26.C04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (469)..(469): a, c, t, g, unknown or other
  misc_feature (469)..(469): n is a, c, g, or t
tcagtacacgtgatcacgaccggtgctcgatttagtctagcgacttttgggtttgggctgggagaggagcccagcactagaggtcggcggtgtttccattcggtgatcagcactgaacacagaggactcaccatggtagtttggctgagcttggttttccngttgcttgttttaagngtgtccagtgtcaggtncagcgtggtggagtcgtgggggagcgtcggcccagccgtgggacctcccgtagacgtaccttcgtccgttggtacgcgtagtccggttcgttaggtaacttcccgtaaccgtttagaacggttacgttcaaggtccggcttaagtccgccgtaccggttggggcccccgtaccgaaggtccctacccggaagggtccgggtaaagggggccttagggggtaacggttcgggggtttacgaacgttaaggttttagaacgggtttgggttaaacgnggttaaaggttagggtaaaacgttaccttaacgtaaagtttccgtaaaggtccgaacccgttaacgggtacccgttacccgggtaagggtaaccggttaacccgtacgtttaccccggcccggttaccgaacccgtaacggaaccgtaaacccgtaacccgtaaacccggaaacgtaacccgaacccggttacgttacgttaccgtaagttaccgaaccgtaacgacccgtaaccgacgtaccgtagaaccggacgtaacccgggagtaaccggacgggttacttacgtaggtttaaaccgttcggaaggtacccggaacgtacggaaacgaaccggtaacgtacccggtacgtaaccgg

SEQ ID NO: 265372 - DNA, 686 bp, Homo sapiens
  misc_feature: GYAE6OF01C4SN1.34.26.C04.1.454.CMB.1.raw
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
  modified_base (541)..(541): a, c, t, g, unknown or other
  misc_feature (541)..(541): n is a, c, g, or t
  modified_base (585)..(585): a, c, t, g, unknown or other
  misc_feature (585)..(585): n is a, c, g, or t
  modified_base (671)..(671): a, c, t, g, unknown or other
  misc_feature (671)..(671): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagcttgggttttccctgttgcttcgttttaaagnggttgtccagtgtcgnggtgcagtcgtgggtggaggtcggnggggggacgcggtcggcccgacgtccgttacggggacccttcccgtggaacgtactccgttccgtggtcgacgnggtccgtcgtagtacttacctacccgttagaaggtacgtacaggtccggtcaacgtcgccgtccggtacgggtcccgaccggtcggaaccctccgggaaggaccgggtaaaggggtccgtaggggacggttcggggtaggacttaggtttacgtagtggtagtcgtaagttaaggtaagtacgtactaagttaactagcgtaccgagtacctacggtaggaccggttccgtaatccgaacgttccncgaaacgagaaccaacgtaacccaaagacccgtacgtagtactntacgacaagtacgacctacgcggctacggacgtacgaaccggagaccgtagtagtagtattactcggtcgaaggtacaggaaacgngacgccgtacgtacg
